United States Patent 9,254,311 (MODIFIED POLYNUCLEOTIDES FOR THE PRODUCTION OF PROTEINS) - sequence listing, part 2

SEQ ID NO: 568 - DNA, 2126 bp, Homo sapiens
cggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggtcctggatttatttctcgattcgctgtcggaggagaatgagaccctggtggagtttgctattggaggcctgtgcaacctgtgcccagacagggccaacaaggagcacatcctgcacgcaggaggtgtcccactcatcatcaactgcctatccagccccaatgaggagacggtgctgtctgccatcaccacgctcatgcacctgagcccgccgggccgcagctttctcccagagctgaccgccacgcccgtggtgcagtgcatgcttcgcttctccctctcggccagcgccaggctccggaacctggcacagatcttcctggaggacttctgctccccccgccaggtggccgaggcccgcagccggcaggcgcactctgccctgggtatcccactgccgaggagcgtggccccacggcagcgctgatccatggagactgcgagaccgtggcacccctactgctggagaccacagtcctgatgtggacgcagggaacggggagcacatactgccccattggtgccttttcagccatctgaaaggcgggttctttcagcaggacaggcatttacactgatgaaacgccactgggagtgaggaagccagactccagagacacggagaagatcaaactggagctgcgttcataggctggcactctcaatcctacatcaggtgccaccaccaccagactcaggccctggtgtaagaagcggccaagtgcctggacccagaggctttgcaggacagtgttctcaggagctgggcctgaggcttaggagagctgccttcgctgcaggaaatcagggattatcccttaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctggtaactgcatcttctccccttgccaccccatggccccggctgaaagcttcggccctcctctgctgtcactcaatgatggggagccctaccccagaagtgtatcccacgagggcatcagggacgcagtgagtgttgctcaagggagtcaggaagagacggcaacgtaaaggatgtggctccatgtccatggtgccccctggtcaacataaggagcgtgggatccgatggaaaggtggagctcagggaaaatgggggtccttgcctctcgtgtaccccctcaaggctgaccccttagatggcccaggaatggcaggtgctacaaaaatggtacccacgtgggcatggaaatggggcagattaggggaccactggactcagaggggagggaagggctcatcagcacccgctcagggagcctgtccctttatgttcccaaataaagggtcctagaagactagaaagccaaggtcttttattaaaggtcccgactggt

SEQ ID NO: 569 - DNA, 3181 bp, Homo sapiens
gagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagcctagtctaacactgaactcatgttcttgatgagaatacttctagatgaggagtatagtggtaagtaagctctgacttggctccttccacaaaccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaaagttataattattaatta

SEQ ID NO: 570 - DNA, 2558 bp, Homo sapiens
gctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttatttt

SEQ ID NO: 571 - DNA, 731 bp, Homo sapiens
ccacctctaacccaggctcagagtagctgctgtttctgagagaacgattccggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacct

SEQ ID NO: 572 - DNA, 807 bp, Homo sapiens
aggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagaatgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcac

SEQ ID NO: 573 - DNA, 829 bp, Homo sapiens
gcggccgagccaaagacgtttccaactccgggagctcccgccggtgcgggttcccaggatggcgtctggcaggcggggtggctgggcttatagacaactggctgggcggcgcggcttggactttgccaagcgtttcactgagccttccttttagcgatgccgcttcccgggggccgaacgctctgccttgtgaagcgccgggcttgcagccggcctgagaacgagcgcccactcagctctcccgggctttggcaagaagaggtgcaggctccttggcccccatttcctcagagctgccaggccaagtctgtgcggcttctatcgcgtcccagcacctgggcaccggctgaagcagtttgctttttggcaatggtgattcgtatcagctgcaactcttcctagtgtgtgtggttttttaagcccctttcctccgctctgctcagaggtcgcggctctgagtcagaggaactctatgttccctgtgcctggtattccgtttttctttaaggggagtcaaacattgaaggggggaaaagggggtgagatttatttccccattgttgaaagaagggaacgtattgacatgccaggaagtaaaacctgttttttttttttttaaaaaaagtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgt

SEQ ID NO: 574 - DNA, 4790 bp, Homo sapiens
tgcggaaaccgctgcccgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaa

SEQ ID NO: 575 - DNA, 2910 bp, Homo sapiens
gcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagcctagtctaacactgaactcatgttcttgatgagaatacttctagatgaggagtatagtggtaagtaagctctgacttggctccttccacaaaccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgac

SEQ ID NO: 576 - DNA, 3043 bp, Homo sapiens
cagatcttctttgcgcatgcggaaaccgctgcccgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaa

SEQ ID NO: 577 - DNA, 2777 bp, Homo sapiens
gcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaatta

SEQ ID NO: 578 - DNA, 2465 bp, Homo sapiens
gctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttatttt

SEQ ID NO: 579 - DNA, 2122 bp, Homo sapiens
taccaggatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttatttt

SEQ ID NO: 580 - DNA, 2300 bp, Homo sapiens
tccctcccaggctgctccgcgtcggcggcgccccgcgcgattggctgcgccgcccccacgtgacgccggggtggcggcggcggttgcccgggtgacggctgcggaggtggcggccgggctgggatagcgcgagtgtccgcggccgagcagcagagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccattgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttgataaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagctcggagaactctcaggagagaagcttctgaccacggagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagca

SEQ ID NO: 581 - DNA, 2560 bp, Homo sapiens
gttgcccgggtgacggctgcggaggtggcggccgggctgggatagcgcgagtgtccgcggccgagcagcagagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccattgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttgataaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagctcggagaactctcaggagagaagcttctgaccacggagtacctggggatcatgaccaacacggggaagacaaggcggaaggggctggctaatgtgcagtggagcggggatgagcccctgcaaaggcccgtcacccccggcggccacagaaacgggtacccagtggtggaagaccaacacacacctccccagacagcccagcacgccagaaacggccacccgcaggccctgccagccgctcacgaggctgtctacagggagggcaagcccagcaccccggagtcctgcgtctcctcttcatcagccatcatcgccaagccaggagagtggctcccaagaggacgccaggaagagcctcgcccagcccccacgccccgccagccaagggaggcgccccaggacccaggcaatggagtgaccaccagggaatgtgcatcagccttcacctgcaagccccgggccccctgcactccagagatgctggactggaacccacccaaggcaaaggcgtcagttctggcccctctgttctcttcgtgtggcccccagcaggccagccgccccggctccacagcgtcctccacaaggggcctgccgagtaaggaaacacacccaaaa

SEQ ID NO: 582 - DNA, 729 bp, Homo sapiens
gggaggagcagcggtgcgtttggagggccgaggctctgcggacctcttgttccgaggaaaaacccgacgcgcccgctccgccgccgccggatgctaccacttctcgcctgcggtccagggatctttcttcggcaagggccgaggcggccgcctggacatcccaagaaaggacaggcccagctgcttcccagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccattgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactct

SEQ ID NO: 583 - DNA, 3730 bp, Homo sapiens
agatctgggactagatttcagaggaaatggtagactttcatagctcgggggaggggaggtggagggagaggctgctgtcccaggagcctagggaaggaagaggcaatttttcataaaagtacaagtggcccatagccccaggggaagatgccgtccctttctggtaatcggtggaagggaaacacaactacaaggtgatgagattatcgaagaagaaagagtaataaggcctggtgtgggggagggaaaggaggggggcgggccctcttctgccgcactgctggtgggaggggaaattggggacccgagttggtggatgacgtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtga

SEQ ID NO: 584 - DNA, 3318 bp, Homo sapiens
tctctcccactcgccgcccgctttccaagacatatgtcccgcttgcagcccatttcgatgctgcgaaacgtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagt

SEQ ID NO: 585 - DNA, 7420 bp, Homo sapiens
ggtgtactgccaagagaagcaagaggagaggagggaactgcctcggatcattacaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaa

SEQ ID NO: 586 - DNA, 1928 bp, Homo sapiens
cacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagtgcagggaaaggggtgtggcggcctttgctggggaaatggcggacgacaagtggggcggaggaggcctgcgtccggaaagtcagtagaattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggc

SEQ ID NO: 587 - DNA, 1758 bp, Homo sapiens
cacgtgaccaagagccgcctagagcacaagtcctgctagtcgcctccgtctgggtaccagccccctattactctgcaggcgtgtgaagaaagaaggaaactagctcggaccgtgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggc

SEQ ID NO: 588 - DNA, 1846 bp, Homo sapiens
cacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcagaaaa

SEQ ID NO: 589 - DNA, 2899 bp, Homo sapiens
gaacttcgaaagactggaacacttccgcctgtcaggccagaagagatttcctgacaccacagctggaaacccatgtgcatttcagttcaggaaagaatgcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaa

SEQ ID NO: 590 - DNA, 2647 bp, Homo sapiens
gctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactgg

SEQ ID NO: 591 - DNA, 2672 bp, Homo sapiens
aaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtg

SEQ ID NO: 592 - DNA, 2901 bp, Homo sapiens
gaacttcgaaagactggaacacttccgcctgtcaggccagaagagatttcctgacaccacagctggaaacccatgtgcatttcagttcaggaaagaatgcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtg

SEQ ID NO: 593 - DNA, 2782 bp, Homo sapiens
gaacttcgaaagactggaacacttccgcctgtcaggccagaagagatttcctgacaccacagctggaaacccatgtgcatttcagttcaggaaagaatgcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtg

SEQ ID NO: 594 - DNA, 1218 bp, Homo sapiens
gagagattcagctgctttcacaactctggctggattttacctatgtggagagtgtcacccatgttagggagcctctggccaggaggaagctgtggcaagatgtgctgcgtctcctgcttggcattgccatcttgctgccacagaacctccactcaatacaccagaaaacagagagtatcttgcagaaattatgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccagaagtggatcaaacagtacacgggtatcaatgcgatcaaccagaagaagtttgttatagacgttggttacgaaagattcctgggacctgaaatattctttcacccggagtttgccaacccagactctatggagtccatctcagatgttgttgatgaagtaatacagaactgccccatcgatgtgcggcgtccgctgtataagatggaacaaattccactgagctatcctcaaggtcacggattccatcctctgtcacctccatttcattgagatgatatattgagcccatgcgtagccttttatttgagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacgtggggcagcagcaagcccaggtgaagatgtgcatgttcttggagaaagtattaataacataccgacacttacatctgggtgaataatttcatcaaatctcttaactcacgcttgcacaaacttcacctggagagagagagggaaagctgtgccagaaataaatggttattgaggtc

SEQ ID NO: 595 - DNA, 502 bp, Homo sapiens
agcgaaggggccgtgaggtcaacagtcggtaatcgtttatcggtgcggccttagagaaaggacctccaagcccttgttcaatacatgttgggtggtggtcacaggtgccagtctccggacggatggcggcctagatttcctcccggactcggtggcacccaaggccccctgcacgccggcgctgtgcgtgccaggctgaccgcccgagtgcgacccggacctcgtccgcacgtgcagatggaaggggccacaaagacgataaggatccaggtctcccgcgtggaaggctcatctatcgacagaacctccactcaatacaccagaaaacagagagtatcttgcagaaattatgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtg

SEQ ID NO: 596 - DNA, 1280 bp, Homo sapiens
gtgtttcggcgcgagggcaccgctggcccagcaggtggccccccggggccggcacgggccccgacagccgcccccttccctgaacctcggcggcccagtccccgcttacctgaggggtggagccggcagcctgcggagccactggccaagctgggaagtccggcgcaactccgcaccgcagagccggcgcctcctcggcagacagaacctccactcaatacaccagaaaacagagagtatcttgcagaaattatgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccagaagtggatcaaacagtacacgggtatcaatgcgatcaaccagaagaagtttgttatagacgttggttacgaaagattcctgggacctgaaatattctttcacccggagtttgccaacccagactctatggagtccatctcagatgttgttgatgaagtaatacagaactgccccatcgatgtgcggcgtccgctgtataagatggaacaaattccactgagctatcctcaaggtcacggattccatcctctgtcacctccatttcattgagatgatatattgagcccatgcgtagccttttatttgagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacgtggggcagcagcaagcccaggtgaagatgtgcatgttcttggagaaagtattaataacataccgacacttacatctgggtgaataatttcatcaaatctcttaactcacgcttgcacaaacttcacctggagagagagagggaaagctgtgccagaaataaatggttattgaggtc

SEQ ID NO: 597 - DNA, 2466 bp, Homo sapiens
cgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcataggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaa

SEQ ID NO: 598 - DNA, 2495 bp, Homo sapiens
gggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtgg

SEQ ID NO: 599 - DNA, 2517 bp, Homo sapiens
ggaagttcgccgacgacgcgcccgccctgggccaccggcgccggcccaagttcgccgggggggcccggaggaagcttgggggacgcgacgggggaacgcggaaaccccggggatctgcaggcgcgcccgggccgtgtgccttctctccgcgtgtccaaaccgtgtccccagccgcgcgccatgcgctctgggggcgtgcgcagcttcgcgctggagctggcgcggggcccgggcggcgcctaccgcggcggggagcggctgtgcggccgggtgctgctggaggcggcggcgccgctgcgggtgcgagcgctcgaggtgaaggcgcgcggcggggcggccacccactggttggagggtcgcagcgtgggcgtcaacgccgtatccagcgactacgcggccgcggagacctacctgcggcgtcggcagctgctgctccgagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtgg

SEQ ID NO: 600 - DNA, 4072 bp, Homo sapiens
aaagcgacaggcctctcggcgagccggtgccccatcgggtaccgcacggctgccgcggcggccttaccctgccgcgagcgcctgtgacagcggcgccgctgtgctcgcgaccccggctccgggcctctgccgacctcaggggcaggaaagagtcgcccggcgggatgggcggggaggctgggtgcgcggcggccgtgggtgccgagggccgcgtgaagagcctgggtctggtgttcgaggacgagcgcaagggctgctattccagcggcgagacagtggccgggcacgtgctgctggaggcgtccgagccggtggccctgcgcgcgctgcgcctggaggcccaggggcgcgccaccgccgcctggggcccgagcacctgcccccgcgcctcggccagcaccgcggccctggctgtcttctcggaggtggagtacctgaacgtgcgcctcagcctgcgggagcccccggccggtgaaggcatcattttattacagcctggaaaacatgaatttccatttcgctttcaacttccatctgaacctttggtcacctcgtttactgggaaatatggaagcattcagtactgtgtgcgggcagtgttggaacgacccaaggtacctgatcagagtgtaaagcgggaactccaggttgttagtcatgtcgatgtcaacacaccagcattattaacccctgtattgaaaactcaagagaaaatggttggctgttggtttttcacttctggtccagtctcgctgagtgccaaaattgaaagaaagggatactgtaatggagaagctattccaatctatgcagaaatagaaaattgttcctctcgtctgattgttccaaaggctgctattttccaaacgcagacatatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaagcaccaccaaattatgcagatgtggtatcagaggaagaattctctagacacattcctccttaccctcaaccccctaactgtgagggagaagtgtgctgtcctgtgtttgcctgtatacaagaattccggtttcaacccccacctctttattcagaggttgacccacatcctagcgacgtagaagagagccagcctgtttccttcattctctgaacgtatttcagaaatcactgtgttcatcatcaaattagaatgttggttcttttccttctgcctttttgggaaagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacggtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtaagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcactaaatatgaaactgggccaaggggaaaattcagtaagttagcgttaaatggaagtaaatatatgtatacctaagagaatgtcaaaataaacaccaaaccaaaagaaggtaggagtgccatttttagaaaagacacaactttaattcctgtcaagagacctaggtctactgatggcagtcactgcattgtacattattccagttcttcagtaattctgtttaaactgtgattttctttattgtgttggtgcaatattttattatcatttaacctcaggatattcagaccaacaggattgtgttgctgctgaaagtctgagcagtgttttaccgtccccagcccccctcccacatggtcacatgttcacttgcttttccttccatctgttggttttgtgagctgagagcatctctggacacatggaagggagccagggattcctgtgatacagattttgaaccagcagagtactttggttttcttcatgtcctaagggtttgatccagaaaccctggtgcttcccctgcagaatactgtacttcatttaacagaatgattgatttttctttcaatcagcatgttcaccaaaaatagaaaagttcttctaaggttaaattttgtatttaaaagttagttggccatttgatcagggaattttctacacacattaggcaaatgtatgcttttcatcctctgggcttacctctctcctctgcaatcctggaagcatcgtgcatagttctttcattgtaagccgctatttaaattcccacaatgcaaaactgttagaccagtaattgtgctactgaaattgtcacaaaacgttattccttgatttggtttttaaattttgctttcgtgtgtgtgtctttaaacaggtaatgtgtatttaagtgttgtctaaacagttgatttttactttagaaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggacttaagagaatagctaaaaggtgtgacttgccttattgaaatgatactggcatatctgactgtaagcagtaggttgaagatatcattttatgaatgtggagaattctacattgaaacagaaaatacctgggaatgaagattaaaaatgtagctgctgttatttgcttggttattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgcttgtttgaaccctatgggttcgttttattaataaaattattacactaatgcta

SEQ ID NO: 601 - DNA, 1884 bp, Homo sapiens
atgcagggagaagcagatgccaggactggatgtgcagaatggcaaggtgaaggcatcattttattacagcctggaaaacatgaatttccatttcgctttcaacttccatctgaacctttggtcacctcgtttactgggaaatatggaagcattcagtactgtgtgcgggcagtgttggaacgacccaaggtacctgatcagagtgtaaagcgggaactccaggttgttagtcatgtcgatgtcaacacaccagcattattaacccctgtattgaaaactcaagagaaaatggttggctgttggtttttcacttctggtccagtctcgctgagtgccaaaattgaaagaaagggatactgtaatggagaagctattccaatctatgcagaaatagaaaattgttcctctcgtctgattgttccaaaggctgctattttccaaacgcagacatatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaagcaccaccaaattatgcagatgtggtatcagaggaagaattctctagacacattcctccttaccctcaaccccctaactgtgagggagaagtgtgctgtcctgtgtttgcctgtatacaagaattccggtttcaacccccacctctttattcagaggttgacccacatcctagcgacgtagaagagagccagcctgtttccttcattctctgaacgtatttcagaaatcactgtgttcatcatcaaattagaatgttggttcttttccttctgcctttttgggaaagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacggtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtaagagaaagaagggagagaaaaggttgcatctgcaggatgccttgataactacacagtcccaaataaaaggcctttttctaacct

SEQ ID NO: 602 - DNA, 1638 bp, Homo sapiens
atgggggacagagaggaatgtctctctaccccccaaccccccatgtctgtggtgaagtcgatcgaattagtgctgcccgaggatagaatctacctggctggctccagcataaaagggcaggtgatcttaaccctgaacagcaccctggtggaccccatagtgaaggtggagctcgtgggaaggggttacgtcgaatggagtgaagaagccggggcatcctgtgattatagcagaaatgttatttgcaacaacaaggcagactacgtgcataagacaaagacattcccagtggaggataattggttaagtgcaggcagccacacctttgacttccatttcaacttacctcccaggcttccttctaccttcaccagcaaatttggccatgtcttctatttcgtacaagcttcctgcatgggcagggaacacattttagccaagaagaggatgtacttattggttcaaggaacttccaccttccacaaagaaaccccattccagaaccccttgttcgtggaggctgaggagaaagtctcctacaactgctgccgccagggcactgtctgtttgcaaatccagatggaaaggaacaccttcacgccaggagagaaggtcgtcttcacaacagagatcaacaaccagaccagcaaatgcatcaagacggtcgtattcgccctgtatgcccacatacagtacgagggcttcacgcccagtgcagagcggcggtctcggctggacagcagcgagcttctgaggcaggaggccaacacccccgtgacccgcttcaacaccaccaaggttgtcagcaccttcaacctgccgttgctgctgtccgtgagcagcagcacgcaggacggtgagatcatgcacactcgctacgagctggtcaccaccgtgcacctgccctggtccctgaccagcctcaaggccaaagttcccatcatcatcaccagcgcctcagtggactctgccatctgccagctgtcagaggacggagtgttacccgtgaacccagatcaccagaattaagtgcccgaacttttaaatattaaaagctttattagtctctaccaggaggaagccctctctcttgcacaggtgactctcagaggagtcgaggagtgggcaacaggttgtctgcaacctccccaagctctagcggtttaggtatctgtgtctcccctccctagaactatcactgaatgcctggaatggacaaaggaaaccgggaaggtctcccaggacccaaacccggcataacctgccttttccaccctgagtctgccccagcctactggggtctcacagtgccaagaccaggggtcctacttggggagaattctcccctctgctaatgtctggttgtattggctgtcacaactgcaggggatcgggggagaagagtcttattggcgtggagagggtggaggccagggacgctgttcagcaccctgcagtgtccaggacggcccccacaatcaggaattgtttatcctgaatgtcaacagtaccaagggggctgagcatggtggctcattcctgtaatcccaggactttaggaggccatggctggaggatcacttgagaccaggagtttgagacaagcctgggcaacactgtgagacccccatctctaca

SEQ ID NO: 603 - DNA, 3832 bp, Homo sapiens
atgtcctaaatggtttccactgcgcacagcttcctctcagcccgctctgagctggaagcagcatgtgggacctggccctgatcttcctcgcagcagcctgagtgttctcactaggggtcactctgtgggtcatttgcagccattttttcactgtgcacatccctgcagcggttggccaccctgtgaaactgagagtcctccattgcatcttccagctgctgttgacatggaaacccaccatggcatatgctctcgtttgtgcaaggagagtgactccgtggttctggcagttggttaccgcaagttacctaagcataagtttccagtgccagtaagagactgcttggtggccaccatccacttcctgaagtccctggatgcatatggagtggatccagcccgggttgtggtctgcggtgacagtttcggaggggcaatagccgcagtggtttgtcaacaacttgtggacaggccagatctgccccggatccgggctcagatcctgatctatgccattctccaagccctggatttacaaaccccttcgtttcaacagaggaaaaacatcccactgctcacctggagtttcatctgctactgtttttttcaaaacctggatttcagctcctcctggcaagaggtcatcatgaaaggtgcccatttgcctgctgaagtctgggaaaagtacagaaagtggttgggcccagaaaacatccctgagaggtttaaggagaggggttaccaactgaagccccatgagcccatgaatgaagctgcttacttggaagtaagtgttgtcctggatgtgatgtgctcgcccctgattgcagaagatgacatagtgtctcagctcccggaaacctgcatcgtgagctgtgagtatgatgctctccgggacaattcactgttgtacaagaaaaggctggaagacctgggagtgcccgtgacctggcaccatatggaggatggtttccatggagtgctcaggaccattgacatgagcttcttgcactttccctgctccatgagaattctgagtgcattagttcaatttgtaaagggactgtgaccatctttcttctctgctggtactgcggtgtggattccactggcatccagcctcccacagggctctctgttgctgatttaggtggtgcatagtggggctagggaggaggtagaggttgctgtcacctttctggtccaggttctagaaccacacaatgcatgctcctgatgtccagaggacgtggtagaaaagacaggtttggaggtgggagtgtggctgtctctattctctgttgggaaaacctgggctgacaatattcagtggccatttgtgggagtgaatcagccggtaagagctgttctcagcctctctaaggggcagttcaggctcccagattgatccagactgtgtgtgactttcgtccatttgacttgactttggaatagcacaagggcatcacgtacttcacgaggctttcccaatgtggctcagaggcaggagctctgatgctctaggctgctgtgaggtggtggtggtggtggagaaactggcttcacccacctactcttctgtgaacagtagtgacttttcccgctgtttctcagcctctgggatcagagtcttcactgtctgggctggaaactttaagatagaatggatagagcttccacagtggttggcatctagtggtggatgaagacagcctgcagctgcccgacttggggagctctggagctcctggaatcaaagcctgtcttccaaccagaagccccaaggcaatgttctaagaatttgagaagagaagttgggagggaagtggggtcctgagttagagacccatgaaggctgagtctaaccagataaccctgtccacagtgcaaagtcaagacagccaaaggaacagaagatgtatttgtgaaaactatttcttttttaagacatggaaccaactcaaattggcctctattagaaagacaatagattggcttaggtagggatgcatgctaggcatacatcaggcaaggtttgatccaggaactcacacagtgccatcagctgtcctgtcttctctgctctgctcttctctcctctgtgttaatgccaccttctcctcttcatacggtggcactgagcagcttcatgcctaccttcctccagggtcaagttcattatcatggacttgcctcatgctcagcagtcccagaaaaaagcctaattgcaacttgatggctttgttggctttctgagcaatgtgtccagttgccacagtgaagggaatggaataatctaactcaccattcccaagtcctatgccatcctgagagtggggggtggagtcaattcaccttggtgcttggactaagcatgaggtggtgagtgacaacgttcctaattgaagggtagggtaaatggttgttgggtggacaccaacacttattctactacagaagctaaattgaaccctcaggcagggtacgtgaaagtggcaagagatgtcaagaccactgggcaagttggccagttgttccttaggaatgaaaattcttttgaaaggaatggccagggtcctctgctggccccacttggtcttctggaggctctgatcttggttggttagtggtctttacaggccaaggtcaaggccattgcacaaaaaaccctgtgcatgcccttaacttgctttcagttgaatatttgggctgaactatgaggcagagaggaatcccactgggtggctccttgctgcattcgcagttgaccagcatggggtttgttggagaaataggaaccatcccctgaaaacacacactatggtagccactcaactgttgaaaggcactggagtccaatgggtgaggccgcctctgagacaagcctctgagttgaggctgggagaggctccctccttggagtgttgctttttttgtttcacccctgcctctggagatgggtagaggaacatgagctgaccttctgggaagttaggttggtgaggagttgctgaggcactgcagggccatgcccagtagagaggaatgtataacattttaagaggctgagagcaccccttgttggacgcatgcccatggcagcttccttctgccgatcatgggagaaatcaagcactttcacctaatggctagatgattgattttgggatgaaattctccactcctctcctttaccacatcaccactatccttcctgcaatacatccacgagactcactgagtggaaaagggataggaatgaatgttcacccagggccagctacatgctaggcactgtactggaccatttaaatttgccacctcttatgttcctcacattaatcttacagagtaggtacagacatacctatggatattgcagattcagttccagaccacagcaataaagcaagtcacatgaattttttgctttccttagtgcatgtaaaagttacatttccactatattatagtttattaagtgtgcaatagcattatgtctttaaaaagcgtgtacataccttaatttaaaaataccttgttgctgaaaaatgctaacaatcatctgagccttcagtgattgcagtagcctaggctactattttctatgtggggtttgcacattctgcccatgtctgcgtgggttttctctgagttctccagcttcctcccacattccaaagatgtgtatgttacattcatgggaatgtctaaattgtcgtaatctttttgctggttgatggtcttgccttgatgttgatgctgcaggtggtggttgctgaaggtgggggaggctgtggcaatttcttaaaataaaataagacaacagtgg

SEQ ID NO: 604 - DNA, 1258 bp, Homo sapiens
gcttcctctcagcccgctctgagctggaagcagcatgtgggacctggccctgatcttcctcgcagcagcctgagtgttctcactaggggtcactctgtgggtcatttgcagccattttttcactgtgcacatccctgcagcggttggccaccctgtgaaactgagagtcctccattgcatcttccagctgctgttgacatgggggatgatatttgagaagctcagaatctgttctatgccccaatttttctgtttcatgcaagatctgcctccgctaaagtatgatcccgatgttgtggtcacggatttccgctttgggacaatccctgtgaagctgtaccaatccaaggcatccacctgcaccctgaagcctggcatcgtgtactaccacggtggcgggggcgtcatggggagtttgaaaacccaccatggcatatgctctcgtttgtgcaaggagagtgactccgtggttctggcagttggttaccgcaagttacctaagcataagtttccagtgccagtaagagactgcttggtggccaccatccacttcctgaagtccctggatgcatatggagtggatccagcccgggttgtggtctgcggtgacagtttcggaggggcaatagccgcagtggtttgtcaacaacttgtggacaggccagatctgccccggatccgggctcagatcctgatctatgccattctccaagccctggatttacaaaccccttcgtttcaacagaggaaaaacatcccactgctcacctggagtttcatctgctactgtttttttcaaaacctggatttcagctcctcctggcaagaggtcatcatgaaaggtgcccatttgcctgctgaagtctgggaaaagtacagaaagtggttgggcccagaaaacatccctgagaggtttaaggagaggggttaccaactgaagccccatgagcccatgaatgaagctgcttacttggaagtaagtgttgtcctggatgtgatgtgctcgcccctgattgcagaagatgacatagtgtctcagctcccggaaacctgcatcgtgagctgtgagtatgatgctctccgggacaattcactgttgtacaagaaaaggctggaagacctgggagtgcccgtgacctggcaccatatggaggatggtttccatggagtgctcaggaccattgacatgagcttcttgcactttccctgctccatgagaattctgagtgcattagttcaatttgtaaagggactgtga

SEQ ID NO: 605 - DNA, 4642 bp, Homo sapiens
ggctgcgcccaggccggcgggcccagcagctgcgaaccgccggcgcaccacctgtttccgcgcccggggacttccccggcggggctcagaagtgtgggatcggtcgcttggcttcccctggcgtcagcgacccagggtaacctcctccactgctgcgtgccgtgcaggcctgcctgtgtgagagccacgtgtgccgcgctctgggcacagccttggaaagtcaggaccgcgacggcagcagagcagaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttctctggttcccagtttctctggtcattttggtgtaaatccattctaattagtatttagggcagagcttctctctcttttctctttttttccttccacaaaccagtgtactcactggtctccatctttaatatgcaaacaaatcacctgggatcttgtgagaatccggattccgtctcagtagggctcgagtagatcctgaaatcctacatttctatcaaacaatgccttgaggagcacagatttagaccaaagttaggtcgttttccagatctcagagcagacgagtccatggataagtctgtggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggaggccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttcgttttgcccttctgatttccacggcacaagattatctaccaaaatcaaaacagaatggccttactcttctcaggaagaggctggtaggcaggtgcattatcaacaggtctgtgcccatgcagagtgagcagggagaggctgggcactgtggaatttttctgtctgaactcgctcatggccacagaatggtcacccagcttatttaggtgtagacaagtatgacacagttctagaaaatactgactataaaaatgtctctgtgtgtgtgtgtatgtatttatatgtatatgtatatatttttaaaaggctcatcttacttgtaaacatggactgctcaatcactattaaaaagtcagtttaggctgggcgcggtggctcacgcctgtaatcccagaactttgggaggctgaggtgggtggatcactaggtcaggagtttgagaccagcctggccaacatggtgaaaccccatcgctactaaaaaatacaaaaattagccgggcatggtggcgctcacctgtaatcccagctactcgggaggctgaggcaggagagaatcgcttgaaccggggaggtggaggctgcagtgagccgagatcgcaccactgcactccagcctgggcgatggagcaagactccatctcaaaaaaaaaaaagtcagtttaggctgggcgcagtggctcacacctgtaatcccagcactttaggaggctgaggggggtgatcacctgaggtcaggagtttgagaccagcctggccaacatggtgaaatcctgtctctactaaaaatacaaaatttagctgggcatggtagcatgcctgaaaccccagctacttgggaggctgaggcactagaatcacttgaacctaggaggtggaggttgcagtgagtggagatcacgccaacacattctagcctgagggacagagtgagactctatcatctc

SEQ ID NO: 606 - DNA, 2450 bp, Homo sapiens
aaaagaaagggtgagcgcggctggaagcgcgcatgcgctgtggctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccggatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataacatagtagttttaaagttca

SEQ ID NO: 607 - DNA, 2172 bp, Homo sapiens
ctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccggatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaa

SEQ ID NO: 608 - DNA, 567 bp, Homo sapiens
gctggaagcgcgcatgcgctgtggctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgttt

SEQ ID NO: 609 - DNA, 805 bp, Homo sapiens
cagactgctgtgctagcaatcagtgagactccgtgggcgtaggaccctctgagccaggtgcgggatataatcttgtggtgcgccgttttttaagccggtccgaaaagcgcaatattcgggtgggagtgacccgatttcccagctcagaacctgaggacgcagccatggagcggtcggccttcatggagctggatgctgggagcaggctggtgatgcatctccgcgagtggccagccctgctggtcagcagcacgggctggacagagtttgaacaacttactcttgatggacacaaccttccttctcttgtctgtgtgataacagggtcggtggacctgggtgtctgtctgcacatgtcctccagtggcctggacctgcccatgaaggtggtggacatgttcgggtgctgtttgcctgtgtgtgccgtgaacttcaagtgtttacatgagctggtgaaacatgaagaaaatggcctggtctttgaggactcagaggaactggcagctctgcagatgcttttctcaaactttcctgatcctgcaggcaagctaaaccagttttggaagaacctgcgggagtcgcagcagctccgatgggatgagagctgggtgcagactgtgctccctttggttatggacatacaactcctgggccagaggctaaaaccccgggacccctgctgtccttcccgcagcttcttctcggagtctcagggcaaacccttttgagcagcgcctcccagtggccagaagctgaaatgacggcagtggtgccgcctggtgaatgaattggttctgtgacccgg

SEQ ID NO: 610 - DNA, 847 bp, Homo sapiens
gctgccgcagcctgcgccatttccgatgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaaggcgccctgatctggttgtggaagtggcccatcccaaaataatccatgaatctggggcacaaatcctgcgccatgccaatctcctgagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcagagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccgc

SEQ ID NO: 611 - DNA, 1043 bp, Homo sapiens
gccttgtgcagcgggcagcgagcagcccagggagccaggccccagacaccgcactcagggccatggccgacaggggcccgtggagggtgggcgtggtgggctatggccgcctcggacagtccctcgtctcccgcctcttggctcagggaccagaacttggcctagaacttgtttttgtctggaatcgtgacccaggacgaatggcagggagcgtgcccccttccctgcagctccagaaccttgctgcccttggggaaaggcgccctgatctggttgtggaagtggcccatcccaaaataatccatgaatctggggcacaaatcctgcgccatgccaatctcctggtggggtccccctcagctctaagtgaccagaccacagagcggcagctcttggaggcctcacagcactgggaccacgccgtgtttgtggcccgaggggccctgtggggcgctgaggacatcaggagattggatgcagctgggggcctccggagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcagagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccgc

SEQ ID NO: 612 - DNA, 2425 bp, Homo sapiens
gcccgccgaggggcggggctgaccgaggtgggcggggcggatgccgaggggcggggagaggtgggcggggaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctcttctctgtctcaagtccatgtctgaagtgggtgaagggtggactggatcctcaagcagaaggtcacttctcccacccctagtcctccacctgggaaatggcctcaacggtcttccctctttccatccccagaatgggtgtcccgctctgccttcagagatcctgttctgcactgggccaccttcagagctgctctgggcagacaaagctgtttctcaccctcccaaaatcccttcccatcccctctcaggagctgcaaagagaagggcacagtctataccttatcacccttcatcatccacttctcagcagtccctggtattacttgattgtgaacatattatcaggaaaaaagattatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccatctctactt

SEQ ID NO: 613 - DNA, 1842 bp, Homo sapiens
aaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaatcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctc

SEQ ID NO: 614 - DNA, 1137 bp, Homo sapiens
ctctctctctctctctctctctctctttttctagatgtttctctgtctctctctgtctctctctctttctctctctcacatcctgggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattga

SEQ ID NO: 615 - DNA, 1296 bp, Homo sapiens
atggagggtgtagggggtctctggccttgggtgctgggtctgctctccttgccaggtgtgatcctaggagcgcccctggcctccagctgcgcaggagcctgtggtaccagcttcccagatggcctcacccctgagggaacccaggcctccggggacaaggacattcctgcaattaaccaagggctcatcctggaagaaaccccagagagcagcttcctcatcgagggggacatcatccggccgagtcccttccgactgctgtcagcaaccagcaacaaatggcccatgggtggtagtggtgtcgtggaggtccccttcctgctctccagcaagtacgatgagcccagccgccaggtcatcctggaggctcttgcggagtttgaacgttccacgtgcatcaggtttgtcacctatcaggaccagagagacttcatttccatcatccccatgtatgggtgcttctcgagtgtggggcgcagtggagggatgcaggtggtctccctggcgcccacgtgtctccagaagggccggggcattgtccttcatgagctcatgcatgtgctgggcttctggcacgagcacacgcgggccgaccgggaccgctatatccgtgtcaactggaacgagatcctgccaggctttgaaatcaacttcatcaagtctcagagcagcaacatgctgacgccctatgactactcctctgtgatgcactatgggaggctcgccttcagccggcgtgggctgcccaccatcacaccactttgggcccccagtgtccacatcggccagcgatggaacctgagtgcctcggacatcacccgggtcctcaaactctacggctgcagcccaagtggccccaggccccgtgggagagggtcccatgcccacagcactggtaggagccccgctccggcctccctatctctgcagcggcttttggaggcactgtcggcggaatccaggagccccgaccccagtggttccagtgcgggaggccagcccgttcctgcagggcctggggagagcccacatgggtgggagtcccctgccctgaaaaagctcagtgcagaggcctcggcaaggcagcctcagaccctagcttcctccccaagatcaaggcctggagcaggtgcccccggtgttgctcaggagcagtcctggctggccggagtgtccaccaagcccacagtcccatcttcagaagcaggaatccagccagtccctgtccagggaagcccagctctgccagggggctgtgtacctagaaatcatttcaaggggatgtccgaagattaa

SEQ ID NO: 616 - DNA, 2664 bp, Homo sapiens
aagtaggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaagaa

SEQ ID NO: 617 - DNA, 1934 bp, Homo sapiens
tttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcctctagctttcagtgaagtggaaaggattaataaaaatatcagaacctcaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatc

SEQ ID NO: 618 - DNA, 569 bp, Homo sapiens
ggactctcacgtgcaggagccagtcctcgctgggctctagcgggcttctgatggaggagctactcctctgggaggacagagtaggtgggctctgctgcaggtccgggcggcgggttgtgagggccgaggtggcacggtgtatgaaggcctgtgtttgaagacttaggtcagaccttttgcccgcctttcccctatgcagctctatgcaactgtctgtgcaaggtcctgtaatttgcgtaggacgccttgacacagtctctgcttatggacgctttacaaaactatcttgcaaagaaataagtactatacaggataaggttctgagatactgacagggctggaactagggtgagataagtgtaaaatgtaaatggatgccaataaaattcagtaatcaaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggt

SEQ ID NO: 619 - DNA, 551 bp, Homo sapiens
acttgacaacacgctccccctcgaggtttgagtgaacttgggcactgcgaacacatcttctttatttctgcatccccaatccctggcatacctcctggcatatactaggtgtttaacaaaccttgttaaggcaagtaagtgtccagcagatcaactgccgcccaaaggagagaaaaaaggtaataagaggaaggcaatttgtcaccagtttctgctacagcacaaatctacctttaaagtaaatcttaaccttaagaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatgg

SEQ ID NO: 620 - DNA, 589 bp, Homo sapiens
ttccgattcccgctcttgagattggactctcacgtgcaggagccagtcctcgctgggctctagcgggcttctgatggaggagctactcctctgggaggacagagtaggtgggctctgctgcaggtccgggcggcgggttgtgagggccgaggtggcacggtgtatgaaggcctgtgtttgaagacttaggtcagaccttttgcccgcctttcccctatgcagctctatgcaactgtctgtgcaaggtcctgtaatttgcgtaggacgccttgacacagtctctgcttatggacgctttacaaaactatcttgcaaagaaataagtactatacaggataaggttctgagatactgacagggctggaactagggtgagataagtgtaaaatgtaaatggatgccaataaaattcagtaatcaagaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatg

SEQ ID NO: 621 - DNA, 1641 bp, Homo sapiens
aggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaactaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaagaggaagaaagagggaagacaaagaggacaagtcagagaaagcagtga

SEQ ID NO: 622 - DNA, 2974 bp, Homo sapiens
gagtttttccaggggaaaccggcctgggtggagagacagagaaggggagaccgggtgggtgggtcgtacgcttagggggccgtggttggtacttcgctgttggggaggctttcaggtcgcccagatcctgcttcccaatgggtgactgggaaaattagcgggtggaaaatctcgaggggtggaggctttttttttcctccttggccccgccctcttcctgttcggcgactgggacgcctggccctacgagggggaagggaggcttggccgggctatcggagagcgctgtgcgcacgcgcgagcccgagtgcgtgtgtgtgtgtgcacgcgcacgcgcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaa

SEQ ID NO: 623 - DNA, 1198 bp, Homo sapiens
gaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttgcacgtccttagcagttctcgatccattctagaagatccaccttcaattagtgaaggatgtggaggaagagttacagactaccggattacagtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggt

SEQ ID NO: 624 - DNA, 560 bp, Homo sapiens
ctcgcgagtttttccaggggaaaccggcctgggtggagagacagagaaggggagaccgggttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtatta

SEQ ID NO: 625 - DNA, 552 bp, Homo sapiens
aggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaactaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagag

SEQ ID NO: 626 - DNA, 2310 bp, Homo sapiens
aggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaactaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgc

SEQ ID NO: 627 - DNA, 875 bp, Homo sapiens
accggcctgggtggagagacagagaaggggagaccgggaccaggcacgaaagtaagcgaacctcgatcctgaggtcttccctatccactcaccttgtattttccaccccccaccctccagcaaagtgggtctagaaggtttctcaaagagagttttgcatgaaggggagatgcgtcttgaaagcaagaggttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagag

SEQ ID NO: 628 - DNA, 6360 bp, Homo sapiens
ggatggtgagcggcgaagcagccgggcgcccgcgtcgctgccaccgccggaagacagacgtcccccaaaacccctcgcctggctcggacccacggagccggcagcccagcactccgatgggagcttgcctgattgtcaacccatcggcctggaccccagagcccacccagttgagcgtgtgcagagggccccgagtgcggggcgacgctcaggccgttgcagagaccaccctggagatgctgatgaagacaggcctttcctgctgagcccagcctatcttcgcagcctgctcaggattggtatgaagaattaaatgaaacgatgcctggacagcttccagcccagtacctggcgcgcagtaggtgctcactaaacctgagctgcgatggtcctttccaggcgctgtccacgccccgaggcctgggctcaggccgaagttgctccacagcacccccagctgacagccagcgactggcagagcccccaggcacgggggccctctctcttccagagatctccagtgtgacagcccaggcggcagagccgagggtcctggtcccggcttctcgcaccctcatgtcagccccggccccgcccggcggcctgcggaggacaaggtcaggatgcgtgtgaagccccagggcctggtggtgacttccagtgccgtgtgcagctctcctgactacctccgggaacccaagtactaccccggcggcccccccaccccccggcccctgcttcccacccggccccctgccagcccacctgacaaggccttctccacccacgccttctccgagaacccacgcccacccccacgccgggaccccagcacccggcgcccaccagtccttgccaagggggacgacccgctgcccccacgggcagcccgtcctgtctcacaggcccgctgccccacaccggtcggagacggcagcagctcccgacgctgctgggacaacgggcgggtgaacctgcgaccagtggtgcagctgattgacatcatgaaggacctgacacgcctctcccaggacctgcagcacagtggtgtacacctggactgtggtgggctccgactgagccgcccgcctgcaccgccacccggcgacctacagtacagcttcttctcctcacccagtttggccaacagcatccgtagccctgaggagcgggccaccccacacgccaagtcggagcggcccagccatcccctctacgagcctgagcctgagcctagggacagtccccagcctggccaaggccatagtcccggagccacggctgcggccacgggtctgcccccagagcctgagccagacagcactgattactcagaacttgctgacgccgacatccttagtgagctggcctccctcacttgcccagaggcccagctgctagaggcccaggccctcgagccaccatcgcccgagccggagcctcagctcctggacccccagccccgcttcctggacccgcaggcactagagccgctcggggaagctctggagctgccacccctgcaacctcttgctgatcctctggggctgccgggcctggctctccaggccctggacaccctgcctgactccttggagtcgcagctgcttgacccccaggcactcgaccccctgcccaagctgcttgacgtcccaggtcgccgtctggagccccagcagcccctggggcactgcccactggccgagcccttgcgcctggacttgtgctcaccgcacggcccccccgggcctgagggtcaccccaagtacgccttgcggcgcactgataggccaaagatcctgtgtcgccggcggaaagccggacggggacgcaaggcagacgccggacccgagggccgcctactgcccctgcctatgcccacggggctggtggctgccctggccgaacccccaccaccaccgcctcctccaccccctgccctgccaggcccaggcccggtctcagtcccagagttgaagccggaatcttcccagaccccagtggtctctacccgcaaaggcaagtgccggggcgtgcggcgcatggtggtgaagatggccaagatccccgtatcgctggggcggcggaacaagaccacatacaaagtgtcttccttgagcagcagcctgagcgtggagggcaaggagctgggcctgcgcgtgtcggctgagcccaccccgctgctgaagatgaagaacaatgggcggaacgtggtagtggtcttcccacccggtgagatgcccattattctcaaacgtaagcgcggccgccctcctaagaacctgctgctgggtcccggcaagcccaaggagccagctgtggtggcggccgaggcagccactgtggcagcggccaccatggccatgccagaggtaaaaaaacgacggcggcggaagcagaagctggcatctccccagccatcctatgcagcagacgccaacgacagcaaggccgagtactcagacgtcctggccaagctggccttcctgaaccgccagagccagtgcgctggacggtgctcaccgccccgctgctggacacccagtgagccggagtcggtgcaccaggcccccgacacccagagcatctcccacttcctgcatcgtgtgcagggcttccggcggcgtgggggcaaagcaggcggttttggtggccggggtgggggccatgcggccaagtcagcccgatgctccttcagtgacttctttgagggcatcggcaagaaaaagaaggtggtggccgtggcagccgctggggtcgggggcccgggccttactgagttggggcacccacgcaaacggggccggggggaggtagacgctgtgactgggaagccaaagcgcaagagacggtcccggaagaatgggactctgttcccagagcaggtgcccagtggcccaggctttggggaggcaggtgctgagtgggccggggataagggtggtggctgggcccctcaccatgggcacccaggcggacaagctggccgaaactgtgggtttcaggggaccgaggcccgggcctttgcctccactgggctggagagtggagcctcaggccgtggcagctactacagcacgggtgcaccctcaggccagaccgagctcagccaggagcgccaaaacctcttcaccggctactttcgctcgctgctcgattcggatgactcctccgatctcttggactttgccctctcagcctctcgcccagagtcccggaaggcatcgggcacctatgcagggccacccaccagtgccctgcctgcccagcggggcctggccaccttccctagccggggagccaaggccagcccagtggcagtgggtagcagcggggctggggcggacccctcctttcagcctgtcctgtccgcgcgccagaccttcccaccaggacgagcagcaagctatgggctaactccagccgcttcagactgccgggcagccgagaccttccccaagctggtgcccccgccctcagccatggcccgctcacctaccacccacccgcctgccaacacctacctgccccagtacggcggctatggggccggacaaagcgtattcgccccaactaagccctttacaggccaggactgcgctaacagcaaggactgcagcttcgcctatggcagtggcaacagcctccctgcctcacccagcagcgcccacagcgccggctatgccccaccgcctaccgggggcccctgcctgccaccaagcaaggcctccttcttcagcagctctgagggggcccccttctctggttcagcccccacgcccctgcgctgtgacagccgggccagcacagtctcgcccggtggctacatggtacccaagggcaccacagcctctgccacctctgcagcctctgccgcctcctcctcctcctcctccttccagccctcgcccgagaactgtcggcagtttgcgggggcttctcagtggcctttccggcagggctatggaggcctggactgggcctcagaggcctttagtcagctctacaatcccagttttgactgccacgtcagcgagcccaacgtgatcctggacatctccaactacacaccgcagaaggtgaagcagcagacggctgtgtcggagaccttctctgagtcatcctccgacagcacccagttcaatcagccggttggtggcggggggtttcggcgtgccaacagcgaggcctcaagtagtgagggccagtcgagcctgtccagcctggagaaactgatgatggactggaacgaggcatcatctgcccccggctacaactggaaccagagtgtcctctttcagagtagctccaagccgggccgtggacggcggaagaaggtggacctgttcgaggcctcacatctgggcttcccgacatccgcctctgccgctgcctcaggctacccatccaaacggagcactgggccccggcagccgcgaggtggacggggcggtggggcctgctcagccaagaaggagcggggtggcgcagcggccaaagccaagttcatccccaagccacagccagtcaacccactgttccaggacagtcctgacctcggcctggactactatagcggggacagcagcatgtcaccactgccctcacagtcgagggccttcggcgtgggagagcgagacccctgtgacttcataggaccctactccatgaacccgtccacgccttccgatggcacctttggccaaggcttccactgcgactcgcccagcctgggtgctcccgagcttgatggcaagcatttcccaccgctggcccacccacccacggtgtttgacgccggcctgcagaaggcatactcgcccacctgctcgcctacactgggcttcaaggaagagctgcggccaccgcccacaaagctggctgcctgcgagcccctcaagcatggactccagggggccagcctgggccacgcagctgcagcccaggcccacctgagctgccgggacctgccgctgggccagccccactacgattcccccagctgcaagggcacagcctattggtaccctccaggctcagctgcccgcagcccgccctatgaaggcaaggtgggtacagggctgctggctgacttcctgggcaggacggaggccgcgtgcctcagtgcccctcacctggctagcccaccagccacgcccaaggccgacaaggagccactggaaatggcccggccccctggcccaccccgtggccctgctgcagccgctgctggctatggctgcccactccttagtgacttgaccctgtcccccgtgccgagggactcgctgctgcccctgcaggacaccgcctacaggtacccaggctttatgccccaggcgcatcctggcctgggtgggggccccaagagcggcttcctggggcccatggcggaacctcaccccgaggacacattcaccgtcacatccctgtagtgccaactgaagtgccgactggaccgcgaggttttgttcctggctttcagaaaaccaacgccaagatccctcccagcgtccacatcgtcctctggcaggagctcctgcccctctgcctcccaccctgccccctacaccccctgcagacccatctccctccaccccctcccacccatctcctccacgcagaagccgaaggtgagccctttctgcacaaaaccagcaattgtaaatactttttaaaaatgtacaaaacttaaaaacaaaacacagttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtattaaaaagaaatgaaaaaaagcaaaaaaaaaacaaaaaaaaaacaaaaaaaaaaaaccaaccttgtgtcttgtgaaagggggagtgagggtggagggaatggaagggacaccgctgggttttgtcaccagctactggttctccagaggagttgaaatacctacacgtgttcctggccactgagttttcccttctgcctgagatctgggttccccctcatttcactccaggccctgcgtctcccctgcctctgagctccccactctgctgc

SEQ ID NO: 629 - DNA, 6438 bp, Homo sapiens
tgatcgaggtgggggggcgccgcgggagcggggggccgtgtccagcggagttagcggcggagaatgtgagccgaggcgcgagccatgctgtcagcgacggcgggcggctcagggctcctccacgactcctctcctcagcagccgggcgcccgcgtcgctgccaccgccggaagacagacgtcccccaaaacccctcgcctggctcggacccacggagccggcagcccagcactccgatgggagcttgcctgattgtcaacccatcggcctggaccccagagcccacccagttgagcgtgtgcagagggccccgagtgcggggcgacgctcaggccgttgcagagaccaccctggagatgctgatgaagacaggcctttcctgctgagcccagcctatcttcgcagcctgctcagaaaggggaactgaggctcatggatatacagtgagtcctacctcctagcctgaggactcttccctgcgccttgatgacctgagagaactgggaggagaaaggggttgtgacaatgaccaggactcagggcagaggtggaaaccagagtgcctgatgtgtgcagctgctgacccccccaggacacctctctaccggagtctgtggaagcagagaactgggaggccaaggattggtatgaagaattaaatgaaacgatgcctggacagcttccagcccagtacctggcgcgcagtaggtgctcactaaacctgagctgcgatggtcctttccaggcgctgtccacgccccgaggcctgggctcaggccgaagttgctccacagcacccccagctgacagccagcgactggcagagcccccaggcacgggggccctctctcttccagagatctccagtgtgacagcccaggcggcagagccgagggtcctggtcccggcttctcgcaccctcatgtcagccccggccccgcccggcggcctgcggaggacaaggtcaggatgcgtgtgaagccccagggcctggtggtgacttccagtgccgtgtgcagctctcctgactacctccgggaacccaagtactaccccggcggcccccccaccccccggcccctgcttcccacccggccccctgccagcccacctgacaaggccttctccacccacgccttctccgagaacccacgcccacccccacgccgggaccccagcacccggcgcccaccagtccttgccaagggggacgacccgctgcccccacgggcagcccgtcctgtctcacaggcccgctgccccacaccggtcggagacggcagcagctcccgacgctgctgggacaacgggcgggtgaacctgcgaccagtggtgcagctgattgacatcatgaaggacctgacacgcctctcccaggacctgcagcacagtggtgtacacctggactgtggtgggctccgactgagccgcccgcctgcaccgccacccggcgacctacagtacagcttcttctcctcacccagtttggccaacagcatccgtagccctgaggagcgggccaccccacacgccaagtcggagcggcccagccatcccctctacgagcctgagcctgagcctagggacagtccccagcctggccaaggccatagtcccggagccacggctgcggccacgggtctgcccccagagcctgagccagacagcactgattactcagaacttgctgacgccgacatccttagtgagctggcctccctcacttgcccagaggcccagctgctagaggcccaggccctcgagccaccatcgcccgagccggagcctcagctcctggacccccagccccgcttcctggacccgcaggcactagagccgctcggggaagctctggagctgccacccctgcaacctcttgctgatcctctggggctgccgggcctggctctccaggccctggacaccctgcctgactccttggagtcgcagctgcttgacccccaggcactcgaccccctgcccaagctgcttgacgtcccaggtcgccgtctggagccccagcagcccctggggcactgcccactggccgagcccttgcgcctggacttgtgctcaccgcacggcccccccgggcctgagggtcaccccaagtacgccttgcggcgcactgataggccaaagatcctgtgtcgccggcggaaagccggacggggacgcaaggcagacgccggacccgagggccgcctactgcccctgcctatgcccacggggctggtggctgccctggccgaacccccaccaccaccgcctcctccaccccctgccctgccaggcccaggcccggtctcagtcccagagttgaagccggaatcttcccagaccccagtggtctctacccgcaaaggcaagtgccggggcgtgcggcgcatggtggtgaagatggccaagatccccgtatcgctggggcggcggaacaagaccacatacaaagtgtcttccttgagcagcagcctgagcgtggagggcaaggagctgggcctgcgcgtgtcggctgagcccaccccgctgctgaagatgaagaacaatgggcggaacgtggtagtggtcttcccacccggtgagatgcccattattctcaaacgtaagcgcggccgccctcctaagaacctgctgctgggtcccggcaagcccaaggagccagctgtggtggcggccgaggcagccactgtggcagcggccaccatggccatgccagaggtaaaaaaacgacggcggcggaagcagaagctggcatctccccagccatcctatgcagcagacgccaacgacagcaaggccgagtactcagacgtcctggccaagctggccttcctgaaccgccagagccagtgcgctggacggtgctcaccgccccgctgctggacacccagtgagccggagtcggtgcaccaggcccccgacacccagagcatctcccacttcctgcatcgtgtgcagggcttccggcggcgtgggggcaaagcaggcggttttggtggccggggtgggggccatgcggccaagtcagcccgatgctccttcagtgacttctttgagggcatcggcaagaaaaagaaggtggtggccgtggcagccgctggggtcgggggcccgggccttactgagttggggcacccacgcaaacggggccggggggaggtagacgctgtgactgggaagccaaagcgcaagagacggtcccggaagaatgggactctgttcccagagcaggtgcccagtggcccaggctttggggaggcaggtgctgagtgggccggggataagggtggtggctgggcccctcaccatgggcacccaggcggacaagctggccgaaactgtgggtttcaggggaccgaggcccgggcctttgcctccactgggctggagagtggagcctcaggccgtggcagctactacagcacgggtgcaccctcaggccagaccgagctcagccaggagcgccaaaacctcttcaccggctactttcgctcgctgctcgattcggatgactcctccgatctcttggactttgccctctcagcctctcgcccagagtcccggaaggcatcgggcacctatgcagggccacccaccagtgccctgcctgcccagcggggcctggccaccttccctagccggggagccaaggccagcccagtggcagtgggtagcagcggggctggggcggacccctcctttcagcctgtcctgtccgcgcgccagaccttcccaccaggacgagcagcaagctatgggctaactccagccgcttcagactgccgggcagccgagaccttccccaagctggtgcccccgccctcagccatggcccgctcacctaccacccacccgcctgccaacacctacctgccccagtacggcggctatggggccggacaaagcgtattcgccccaactaagccctttacaggccaggactgcgctaacagcaaggactgcagcttcgcctatggcagtggcaacagcctccctgcctcacccagcagcgcccacagcgccggctatgccccaccgcctaccgggggcccctgcctgccaccaagcaaggcctccttcttcagcagctctgagggggcccccttctctggttcagcccccacgcccctgcgctgtgacagccgggccagcacagtctcgcccggtggctacatggtacccaagggcaccacagcctctgccacctctgcagcctctgccgcctcctcctcctcctcctccttccagccctcgcccgagaactgtcggcagtttgcgggggcttctcagtggcctttccggcagggctatggaggcctggactgggcctcagaggcctttagtcagctctacaatcccagttttgactgccacgtcagcgagcccaacgtgatcctggacatctccaactacacaccgcagaaggtgaagcagcagacggctgtgtcggagaccttctctgagtcatcctccgacagcacccagttcaatcagccggttggtggcggggggtttcggcgtgccaacagcgaggcctcaagtagtgagggccagtcgagcctgtccagcctggagaaactgatgatggactggaacgaggcatcatctgcccccggctacaactggaaccagagtgtcctctttcagagtagctccaagccgggccgtggacggcggaagaaggtggacctgttcgaggcctcacatctgggcttcccgacatccgcctctgccgctgcctcaggctacccatccaaacggagcactgggccccggcagccgcgaggtggacggggcggtggggcctgctcagccaagaaggagcggggtggcgcagcggccaaagccaagttcatccccaagccacagccagtcaacccactgttccaggacagtcctgacctcggcctggactactatagcggggacagcagcatgtcaccactgccctcacagtcgagggccttcggcgtgggagagcgagacccctgtgacttcataggaccctactccatgaacccgtccacgccttccgatggcacctttggccaaggcttccactgcgactcgcccagcctgggtgctcccgagcttgatggcaagcatttcccaccgctggcccacccacccacggtgtttgacgccggcctgcagaaggcatactcgcccacctgctcgcctacactgggcttcaaggaagagctgcggccaccgcccacaaagctggctgcctgcgagcccctcaagcatggactccagggggccagcctgggccacgcagctgcagcccaggcccacctgagctgccgggacctgccgctgggccagccccactacgattcccccagctgcaagggcacagcctattggtaccctccaggctcagctgcccgcagcccgccctatgaaggcaaggtgggtacagggctgctggctgacttcctgggcaggacggaggccgcgtgcctcagtgcccctcacctggctagcccaccagccacgcccaaggccgacaaggagccactggaaatggcccggccccctggcccaccccgtggccctgctgcagccgctgctggctatggctgcccactccttagtgacttgaccctgtcccccgtgccgagggactcgctgctgcccctgcaggacaccgcctacaggtacccaggctttatgccccaggcgcatcctggcctgggtgggggccccaagagcggcttcctggggcccatggcggaacctcaccccgaggacacattcaccgtcacatccctgtagtgccaactgaagtgccgactggaccgcgaggttttgttcctggctttcagaaaaccaacgccaagatccctcccagcgtccacatcgtcctctggcaggagctcctgcccctctgcctcccaccctgccccctacaccccctgcagacccatctccctccaccccctcccacccatctcctccacgcagaagccgaaggtgagccctttctgcacaaaaccagcaattgtaaatactttttaaaaatgtacaaaacttaaaaacaaaacacagttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtatt

SEQ ID NO: 630 - DNA, 1045 bp, Homo sapiens
tccagcggagttagcggcggagaatgtgagccgaggcgcgagccatgctgtcagcgacggcgggcggctcagggctcctccacgactcctctcctcagcagccgggcgcccgcgtcgctgccaccgccggaagacagacgtcccccaaaacccctcgcctggctcggacccacggagccggcagcccagcactccgatgggagcttgcctgattgtcaacccatcggcctggaccccagagcccacccagttgagcgtgtgcagagggccccgagtgcggggcgacgctcaggccgttgcagagaccaccctggagatgctgatgaagacaggcctttcctgctgagcccagcctatcttcgcagcctgctcaggcgctgtccacgccccgaggcctgggctcaggccgaagttgctccacagcacccccagctgacagccagcgactggcagagcccccaggcacgggggccctctctcttccagagatctccagtgtgacagcccaggcggcagagccgagggtcctggtcccggcttctcgcaccctcatgtcagccccggccccgcccggcggcctgcggaggacaaggtcaggatgcgtgtgaagccccagggcctggtggtgacttccagtgccgtgtgcagctctcctgactacctccgggaacccaagtactaccccggcggcccccccaccccccggcccctgcttcccacccggccccctgccagcccacctgacaaggccttctccacccacgccttctccgagaacccacgcccacccccacgccgggaccccagcacccggcgcccaccagtccttgccaagggggacgacccgctgcccccacgggcagcccgtcctgtctcacaggcccgctgccccacaccggtcggagacggcagcagctcccgacgctgctgggacaacgggcgggtgaacctgcgaccagtggtgcagctgattgacatcatgaaggacctgacacgcctctcccaggacctgcagcacagtggtgtacacctggactgtggtggg

SEQ ID NO: 631 - DNA, 1411 bp, Homo sapiens
ccataattccctcccccacaggcggccctttcctcggggtcccgcctggtaccagggaccccctcagctgggggactgcgcctggaagctgtcatggaggccctgcagaagcagcaggcagctcggctggcccagggggtggggccattggcccctgcatgcccgctgctgccaccgcagcctcccctgcctgaccaccggaccctacaggcccctgagggggccttggggaatgttggggctgaggaagaggaagatgctgaagaagatgaggagaagcgggaggaagccggggcagaggaggaggcagctgaggagagccgtccaggggcccagggccccagctcgccttctagccagccccctggactccatccccacgagtggacctacgaggaacaattcaagcagctgtatgagctcgatgcagaccccaagaggaaggaatttctggatgacctgtttagcttcatgcaaaagagggggacgccagtgaaccgcgtgcccatcatggcgaagcaggtgctcgacctgtacgctctgtttcgcctggtgaccgccaagggcggcctggtggaagtcatcaaccgcaaagtgtggcgggaagtcacgcgcggcctcagcctacccaccaccatcacctcggccgccttcactctacgcacccagtacatgaagtacctgtacccgtacgagtgcgagactcgagcgctcagctccccaggggagctccaggccgccatagacagcaatcggcgcgagggccgtcgccaggcttacaccgctactccgctcttcggcttggcagggccgccccctcggggcgctcaggacccagccttgggtcccggccccgcccctccggcgacccagtccagccctggcccagcccagggttccacctccggcctgccagcgcatgcatgcgctcagctgagtccaagccctattaagaaagaggagagtggaattccaaacccttgtctggcactgcctgtgggcctggcactgggacctacacgggagaaattggcaccagaggagcccccagagaagagagctgtgctgatggggcctatggacccacctcgaccttgcatgccccccagtttcctgccccgtggcaaggttcccctgagggaagagcggctggatgggcctcttaatctggcaggcagtggcatcagcagtatcaacatggccctagagatcaacggggtggtctacactggtgtcctctttgcccgccgccagcctgtgccagcttcccagggtccaaccaaccctgcacccccaccctccacagggcccccttccagcatcttgccctgagaggtcctacttgaaactaagagtcccagccccattgctgaggggggaggagaccccctgctttgattctttctggctg

SEQ ID NO: 632 - DNA, 1470 bp, Homo sapiens
actcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgggagaaagcaagacaacaggagaaatgaaggcatctccaggagtggaccagagagcagccaagccatagagaagcatcaggtgtgagaatggaaaacgcagaagagacgtacaacttctgaaagatctcagaggactggcattgtctggagacggcttcctggaagaggagactccagcagagccctgaagtgtggacaagcttccattcactgcaaattcgtgagcacactctggtgtcaggatctagtaaggaaatgggcttgagcagagcagggggtacctgtggggttcttctcttcattttcaccaccacaaagctggtctaagctgccatcaattcccacctggacaactgcaaaagccttccagctgttcctgcttccactcttgctcctctacaattcattctgcacgcagaagtcagaatcaaaatcaaagttcatcatgtcattctcttgacttgtggcttccctttgctcttaagctaaaagtaaaaatcattatcatggctacaaagtcttgtgtggtctgggccacatcctgtgccaggctccctttcattgtctatattccagtcaagctggccttcaaaatttcagcacattgggtctttctgccacaggcccttgcacatacatgcttttccctctgtacatgtgattttctttcatccccgctttccaaagctaactctgactcatccttcagactgcatcttaatgattacttccttctggaagactcccctaattttcacaactagatgagctctcccttatatgttgaaaacaagtatttcttgtgtgaacagaaatgtttaatgtctgccttcccaactcagccacaagctctgtgaggatggggactcagtctttgcatccctcagagcctaacatagtctcagttaatacgtgatagctggagcgtgacatttcattaggaacagtgaggctagttgagaaattatacctcaccagtatataggagagtaccattaggaattcttaatgggatgaaaacctgaattcatgtctagaccctgccacctgctggctgtgctgttttaaataaattgcagatcctctcaga

SEQ ID NO: 633 - DNA, 1961 bp, Homo sapiens
ccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagcacagaaacccgagccacagggcatcaggtccctcccccctgttcaggacttgcctaaccaatctgctgtcactgagcaacattggggctgcctgggtgtcaactctggagagcgtagcaccccgctaccctctcaacctcgctgcccaaaccccaggccccggcgggcccgaacctggagggatggcagccgatgggggcgtggaagacattaggaagaaaaggaacggccaagactcttttttctttaacaagcatttaactctgcatcaggagccgccaacacagtattctctttcagccaggaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggtaagggacctcctggcaccgccttcaccggctctggggggcagggggagctgggcagcgcccctgcttagccgggcggctccgacaggtaacacaagcttgattcctgttctcgttttccccgaaggcagttttcaccctctgctttgagagcactttactgaacaagtacttgataccacgctcactatgtgctagacactgttctcggcactttacggttattacctcactgagtcctcacgacaccccagtgcagtgagtgcagttatcactttacagatgagtaaactgaggcacagagagattctgagttccccactccacatcggtcagttttatcttttgaggttctgagaacattgtcattaaagagttctgttgct

SEQ ID NO: 634 - DNA, 5417 bp, Homo sapiens
ccctccctccccctttcagaacactcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggttgggaaaaatagcagcctagctttgtcacaatccagtccttcaagtatatccagcccaggacacagccgacagaacacaaacagaacgggcaggataaggactcttccataacaagactatgaagccacttccacatcaattccaggccacctaatcccatccgaggaggccatggggaggaggagggaggggagtgggctggggggagagtctgttttctgtgcactccctgtgactctggcctttcttcttctttttttaattgaccaatttttagttaaaaaggcaaaagaaggtgaatttgagatttacagaaaacagttccagtgtttggtttccgctgtctttcctttcatttgccatgtttttacattcttccaaatttggggtcactcccctagctcctgatgctgctactgtaccatccttttgctccagccatgagagcagacattgcagaatgttggttccaggttggcatgctctgaagctcttgaactgtagcacaggcagagccctttttcttcctgtcatctccacccgattccttccatccctacgtctaccactctctgggtcctcactggtcttcaaaggacctggctctcataggatcccctcaggattgtgtgcagggagagggggctttgctggggaggagctgggagtggagagttggagggtgggtggggttccctcatccagtttccacagcccaccatggctggagccaaatgctagaagcgagattgagaacagtggccgtttagtgatgtggtttacctaataccactgtccagctgtgcagctcagaaaggataaaccagtcagggacaggggccagaacaggtttgggaaggtggcagcaagcagagcatggtgggtaggagatgatccctaaaaaaactggagactgtggtggtctgagctggtcaggaatctgcagaatcccttccaggaatcagtgtgccagtgcccacagcagggtgagctaggagggagaaatcccaggaaaaaggtcgtgagaacccagaaagccactccatgaggaggcacggtgaccacagctgctaaaggttcttaggctgccttcctgggctaggaagagccccccagggagagcttccacaaaagggtatgtgtcaaaccttttgtcagaataaataatagcatttcccacccacccccatgccctgggccacagggacttggtgggatcagcacacccatggatcagcttttgctgtcttagagacagccatccccatgaaggaatggtaaggacagccactgctcagtgaagaacagccatttggaagagccacgctggagccctgcagccatagaactattcacactggagttttaaaagaaacagcaataccataagctctagtagggaatcataatcaggaaaggaattcacaacataaaataggtgttctgtgctattaatcatgtaactttgtatatgatgtatagcaaagatactgggaggttttgtttcatccttaaatcagaaatgaatgctagtttcatagctgggcagaaccctcatccccaccccaaagttttccttttctttcccgttcccccaacccaaagatcagactactgttaagtttcaccacacaattggaattgcaaagacgggaggcaaatggagtgattttcatcaatggaattgcactgacagtgagtgtttcttataggattactaaattttttaatataaaatgatttgtttaaaaatcaggagttgatattaagtaccaggacattagttcggatgatttcatttttatttctacagtgttaaaagtgcacttatatgctggtttatttacgtcttgggaaaagagactgcaaattgaagggatgattgttactttttctttttttaaaaaaaaaaggttaaggagattttaagacttataaatgtttaagaaattataaacaaggttagaccctttgaaaaaaagtttagaagatattcttaaagtaaatttttatagtgttaattttgtaataatttatgttttactatattacagagctaactgaccagaatagtttcagaaacaatatgaaacttaggaaagtttaagcaatgtttatatttttaaaatgttctttgaattatgtttttattgtacatttcttcagactgaaaagtatgtacatatctttgttatttttgcacaattttgtcttgttcggtttcagaggtctgttgttttttataatttattttgagttgtaaaacttgcaggagtaaaaacaaaaaacaaaatctccacaacaaaataaccctctgatttataaactcttatagtcaaagagggaaaacaaaggttgagagattaagtggctgcttctgagaaataatgtctcaaggactaaaggagcaattcaataggtttagacattgtagctctctacatcttgaattggaagctggaataaagagcccccacccccccccccaccctcatcgaatgctgcttactttgtcaaaagactggctatgaccaaggtgaggatatttctggaaaactgggcaaaaagggaaagcccacagtattcttccttggcagtcaaccacaggtttactttacaatgatgtattaaaaacttgcagcttgaaaaatggaatgcaaataaaaggttctctttgggtttgtcttaatggagttaaactggagcagcctataaaacatttttagggtgatgtcctctgggtccttctgttctgcacacccactcagtcttctctcccagccccttgactgcacacacccctctttgcctgaagatctcctgacttgtcgccagccatagaggctcgaaagctctggttgtgaagcataacgcaatgcatagacctgtcagccat

SEQ ID NO: 635 - DNA, 2426 bp, Homo sapiens
actggccagggccctcatccaggagccaggaaacatctactaccacgagtcgcgttgcccagcgtgtgtcagcctccttatccaaacggcaaggcagcctccccgggatgtagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggttgggaaaaatagcagcctagctttgtcacaatccagtccttcaagtatatccagcccaggacacagccgacagaagaacacaaacagaacgggcaggataaggactcttccataacaagactatgaagccacttccacatcaattccaggccacctaatcccatccgaggaggccatggggaggaggagggagggg

SEQ ID NO: 636 - DNA, 1715 bp, Homo sapiens
cagctcacagacaggctcacaggaatatgtgatgcaagaagggggttgagcgagttgactgggctgaccagagctgggtacagttttaactgtgaagattttctggaggaggcggatctgcagcagattatcccctgaggaggaaggggctgggaggtgaaggggctggggagagaatcccttgggagcagtctctctgtctcttactctgtgagctgtgtcgttccctcctgtccttcccttccctctgtcctcttctgattgccctgcagggtgtctgccctggtgccctgctctttgagctcggcaggttcaaggatgcccctactctgaccccacaacagtcacattcccctggcatcccttttggcccttccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaagactgtctccctgttctgttgctgctatgaaaatataaaaacagaaacatagaaaaggaaggaaaaaaaa

SEQ ID NO: 637 - DNA, 2318 bp, Homo sapiens
gcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaa

SEQ ID NO: 638 - DNA, 2314 bp, Homo sapiens
gcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctc

SEQ ID NO: 639 - DNA, 3673 bp, Homo sapiens
aggcgctctgaggggcggaagcggagaggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctgcagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcttggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatggaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgttttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtagtattttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaatttt

SEQ ID NO: 640 - DNA, 1657 bp, Homo sapiens
gcctggcgcctagagaagcggcggggcgagccgggggctctagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggacgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgc

SEQ ID NO: 641 - DNA, 1557 bp, Homo sapiens
gcctggcgcctagagaagcggcggggcgagccgggggctctagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctc

SEQ ID NO: 642 - DNA, 6357 bp, Homo sapiens
ctggcgcctagagaagcggcggggcgagccgggggctctagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggacgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagccggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggccaactgctttgatctcaccccagactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgagcggccgtggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgcca

SEQ ID NO: 643 - DNA, 6376 bp, Homo sapiens
gcctggcgcctagagaagcggcggggcgagccgggggctctagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggacgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagccggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggccaactgctttgatctcaccccagactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgagcggccgtggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaaggtacagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctc

SEQ ID NO: 644 - DNA, 11628 bp, Homo sapiens
ggtgcgggcggggatgctcgagaagggctccagtcctcccagcggagacggcggagccccaagtgtgcgtttccggggcgccgaggtctgaggggagccgggagagccaggccggccagaccggcccccagacccctcttaacacgggcgcggggcccctgcagcctgccgcccctctcggcccagccagctgcatggcgtcgcgtccccatccggaaggcctgacggcccgccggcgccccgagcccctagcccttctcgggggccgcccctcgcccgcagccaccccggctgccgctcacctgcgcgcccggcgtcctcttcttccttcctccggaggcgactggagccgaccggcggtgccgccccctccctccccgccttcttccgccccgccccctcggagccggaactgctccagcccccgcccttctgcccgccttccgcggccccagtgtggcgtcacttccgccagcgcccggcggcgcgccgggagtctgggtctcgtgaacgcgccaggagcgtccctacagccgggaacgcgcctcgcggatgacaacaaattcgtcgcgcggcggcagtggcggtggctgcctcagcccctgccgcctcctctcgcgctctcttgcactctctccgagccggttgggaccctcctcggaagtcccctggcctggggccaggaggacccctctgcgtcttgcctccgccaggcccagcgcgagcggtgcggcgccggcgatggggtctccctgagggactcccggcaccaaatagggatggaggggccgccccaggcttaggccccgccgcggcctggagccggagtcgctaccccgaggccggagccgtcgcaacccgcagccgcagtcagcccagctgccagcagtcactatgccttggccgttttcggagtccatcaagaagagggcctgccggtacctcctgcagaggtacctgggccactttctgcaggagaagctgagcctggagcagctcagcctggacctgtaccaaggcaccgggtccctcgcccaggtccccttggacaaatggtgtctcaatgagatcttggagtcagcagatgcacccttagaagtcactgaaggattcattcagtcaatttccctgtcagttccatggggctctttactgcaggataattgtgcactggaagtgagaggattagaaatggtcttccggcctagacctcgcccagcaactggttctgagcctatgtattggtcaagttttatgaccagcagtatgcaattggcaaaagaatgtcttagccagaaactaacagatgaacaaggagaaggatcccagccttttgaaggacttgaaaagtttgctgaaaccattgaaacagtactaagaagagtaaaagtcacttttatagatactgttttgagaattgaacatgtgccagaaaattccaaaactggaactgcacttgaaattcgaatagaaagaactgtgtactgtgatgaaactgctgacgaatcctcaggaattaatgtgcatcaacccactgcttttgctcacaagttacttcagctctctggagtgtctctcttctgggatgagttttctgcatcagccaaatcttccccagtgtgttcaactgcaccagtggaaactgagccaaagctctcacctagctggaaccccaaaattatttatgagccacacccacagctaactagaaatttaccagagatagcaccttctgacccagtgcagattggacggttaattggtaggttggagttgagtctcacgttgaaacagaatgaagtgcttcctggagctaagttggatgttgatggacagatagactctattcatctactcctgtcaccaagacaggtgcacttgcttttggatatgttggcagctattgctggaccagaaaattctagcaaaatagggttagctaataaagataggaaaaatcgacccatgcagcaggaagacgagtatcgaattcagatggaattaaaccggtattatttgagaaaagattccctctctgtgggtgtatcttcagagcaaagcttttatgagacagaaacagctcgtacaccttctagccgtgaagaagaagtattcttctccatggctgatatggacatgtctcatagtctctcttctcttccaccccttggggaccccccaaacatggaccttgagttatcattaactagtacatatacaaataccccagcaggatctccattaagtgctactgtgcttcagcccacttggggagagttccttgatcatcataaagaacagccagtaagagggtcaacatttccatccaacctagttcacccaacacctttacagaagacatctctcccatctagatctgtttcagtggatgaatcaaggcctgaacttatttttagactagctgtgggaactttttcaatctctgtgcttcacattgatcctttatctccacctgaaacgtcacagaaccttaatccattgacacctatggcagtagctttctttacttgtatagaaaagattgatccagcaagattttcaacagaagattttaagtctttccgagcagtgtttgcagaagcttgctcacacgatcaccttagatttataggtactggcattaaagtatcctatgaacaaagacaaagatcagcttcccgatattttagtactgatatgtccattgggcaaatggaatttttggagtgcctatttccaactgattttcattctgttcctcctcactatacagagcttttaacgttccattccaaagaagaaactggttcccattcccctgtgtgtcttcagcttcattataagcattctgagaatagagggccccagggtaatcaagcaagacttagttcagttcctcacaaggcagaattgcaaattaaattaaatccagtgtgttgtgagctggatatcagtattgtggacaggttaaattccttgcttcaaccacagaaacttgccacagtagagatgatggcatcccacatgtatacttcatataataaacatattagtctgcacaaggctttcactgaagtgtttctagatgattcacatagtcctgcaaattgtcggatatcagtacaagttgccacaccagcattaaacctttctgttcgcttcccaatacctgatcttcgatctgatcaagaaagaggaccatggtttaagaagtcacttcagaaggagatcctttatttagccttcacagatctagaatttaagactgaatttataggaggatcaaccccagaacaaattaaattggaacttacctttagagaactaattggatcgttccaggaagagaaaggagatccatctattaagtttttccatgtgtctagtggagtagatggagatacaacatcgtcagatgactttgactggccacgaattgtactgaaaataaatccaccagccatgcattccattttggagagaattgcagctgaagaagaagaggagaatgatggtcactaccaggaggaagaggaaggaggtgctcattccttgaaagatgtttgtgatctaagaagaccagccccatctcctttttcttctcgtagagtaatgtttgaaaatgaacagatggtgatgccaggagaccctgtagaaatgacagaatttcaggataaagcaatcagcaattctcactatgtgctggaacttacgttaccaaatatttatgtaacactacctaataagagcttttatgagaagctttataataggatctttaatgacttgctactgtgggaaccaacagctccttcaccagtggagacattcgagaatatttcctatggcattgggctttcagtagccagtcagctcattaatactttcaacaaagatagttttagtgcatttaaatctgcagttcactatgatgaggaaagtggatctgaggaggagactttgcagtatttttccactgttgatcccaactatcgttctcgcaggaaaaaaaaattagactctcagaacaagaactctcagagttttctctcagttcttctgaatattaatcatggattaatagcagtgttcacagatgtgaagcaagataatggagatctgttggaaaacaagcatggtgaattctggttagagttcaatagtggttcattattttgtgtgacaaaatatgaaggttttgatgacaagcactacatttgccttcattctagcagtttcagtctgtaccataaaggcatagtgaatggagtgattctcccgacagaaacacgacttcccagctcaacccgcccacactggttggaacctactatttattcctctgaagaagatggcctcagtaaaacttcttcagatggagttggaggagacagtttgaatatgctgtctgttgccgttaaaatattgtctgataaatcagagtccaatacaaaggaatttctcattgccgtaggactgaaaggagccactctccagcatagaatgcttccttctgggcttagctggcatgagcagattttatacttcttgaatattgctgatgaacctgttttgggatataatcctccaacttcatttacaacttttcatgttcatctttggagctgtgcacttgattatagacccctttatttgccaatccgatctcttcttaccgtggaaacattcagtgtttccagtagcgttgcattggataaatcttcctctactctcagaataatcttggatgaagctgctttacatctatctgacaaatgcaatactgtcactataaatctgagtagagattatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaatagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattaggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtgatattgttttatgcttccatgaatattttgcttttcttagagcatattcatagatgcagtactgtgatttaccacaagataattgggaacactttctcaaaatcgattttggttaatatcaggtaaatcattacctaggagtaagagggaaattgttgtcaattcctgactttagattgatccagcagaaagaaaaggtggaactttgtatatatccactgttgaaagttgcatgacctgacttcctgttttctaaagttgggggaatattattgaacttcaatttcagaactgcatttcaatttggggcttggaaaatgtagttaaatcaatttcgttctctaaattttctaagcaggaaagcaatgtaaaccaaaaatcaaaatgtttagaatttataaaaatggggttatatagcttttaattttagtttcctttttactgccaaaaaacttaaaaagacaacagcgtaaccacctgtttaagcaccgtgggaccatctcttattcgggtagagcctggtcctggcgacacactaacaggaaggcgtgctgtgttaccgggaaggcgcctctggctgtggggtgcgttctgaccaccccgctcagatgccagcattttccatttgcccttaaggaaacttgctatgtgtgttaacccagttatgattagtcaaactggaaaacacttgatcaaacttaaaattgtaaaatctgtctaacttttaaatatactttccacagttgtacttaagttcaattaactacagtatagagaaaaataattattctcttctttgcacccggagttgcaaacaaattaagtttacaaatctcatttaaacatatatctttgtaatgtaatctccgcggttctttctttgttctaccctcctgcacctgttgtcgatgtaatcattttgggaacagaaacgttgtgtctcaaaaagattcgttgtcagttcagccaagatgttctttacctgagattctggaaagatgtttatctatatcggaacacttctacattattaaatgtccttaagctttttcttttttacaagtgtcttttcagactttggtgttgtgatgacacagtagaaagagcgtggctagaatccgtggtttgccacatctgcagcttaccaaacggatgacttgtccaggacatctgatccctgtaagcctcagcatccctcctggtaaatggagggttttttacgacaaagcccaaagggaggttttggatgattaggctgtgtgtgcgtgtgagaatgatcacatgtggcgtcatgctttgtacagagcctcagaccactgggcctcgtccagtgagagtcctctctggcgacatcacacgcggagcagccaggggccaccttagatctcagatctctcagagcaatacttttctgaactgccactgtgcctgggtggttgggttggtgtcatgcttctgactagagtagatcgcgcatgtccaccagtgatacgttgagtccttacagttccccccatggagtcccataagcagctccatcgagatctgtcagcaagttgcaggaccccacaatgttctgacatgttaagacccccttacatgacgagtagagaggcagctgaggccacaaccgtgtcttcctcttgaatggagctaactcggaaccccccgttttctcttcctttctgcccaccactgaacattgccttttagataactcagtgtttcttctagatgtcatagcaatagactttcactttcatgaagtttgggtacgatttggattctcgcttaagtacatatatttatcaatatttttataaggcaaagttcacttaaaaaatctttccaagtagcagtgtgcctaagatggcaaaatactaaaaactggtgtttcctgctcctgttgtgtgtcacttttcaagccgattgaaatatttctggcttttagggcattactttttaactatctcctttaaaaacgatgttctgtaggtttagtgtctttgttcatttccaaaagagtccagacaactgtgtctgcccctgcagaggctgtttgtccaaaggcagcatgccgcttccaccggaatgcagacagcaggggagcggaattctaaagcagcgacttaaaatgaggaatccccaattgcactaaatggtttcaggattgactaatcattgtcttaacattaactcagattttcaatgtgtaaagagctgtgtgacttggcgtctgagagatccctctgctttgctttgcttcagagtcctcgcacccgcatcctcagaactgtggggcatggtgggctctaacgagcactccccttctgttttccttcattacttttgacctccttaagacttcagagagaatgtccgtcaagttcttttctccatcaagttctttaagttccttgaaaggaagggactgtgcaaacacaaagcaatattcttttgtatctgcaaatgcatcagctggacataccaattggtatcaaatagaataaaatcaaatataaatgtttgagtcttaggttaaaaaggaaggttatttgtatagtttatagataatgaaggaaaaatttctttttcattgcaggaaatcttgtttactggaagatagagtcactcttttcatataagacaaatagtgctttaatgccaacttctttttatctcaacatttcaggatcatgctaggcacactgcccccttgaatagacattatatgcacagttgcaagtcagccaatgtttttattcagaagtatttccccccattatagtgcctgcatatcagagatacaaaaagcatccaacacactaccgtaataggcttctttggggatgagaaatttgagtctcaacaactcagagtttgagatgtcagcttttttggtaaacgtaggtgttagaggtatattttgctttcctacaacaattgttggcccttgatttcaagcatgttgcttcataggaagcaccagagtgccatctgctgcatttcaagagattgtaaatgtcatctcagctggctcagttatatctctaatgtcccgggtagcagcacctccctctaaaaatatgtttacttcactgtttcacttgtattttgtgtatacgaaatggcagcttccgatttctagttggatttgtcttgcattgtttgtataacttgctggtcacccagggctatttgctttttcattgagaaatttggtaggggtgtctagttcagcttttatgttgatccatcctgacttattttagacattgaatttatctcaccacaagtaaaagaacatgtgtattgactgtctttgctaagtttcctaatttttcctaattatggcaattatggatgtgaataagaatactgatgctgtacaaatatttttgtggaaatgtaccttgttaatgtgactatttaaataatatgaaaataagaatactcttgaagaaaaaattaaaatatttactctttgga

SEQ ID NO: 645 - DNA, 3687 bp, Homo sapiens
ggtggcgcggcagccgggcggctcctccttcctcccggccctggcgtggagcagagggacacaggttcccacgctggcgcccggcgaccgggtggggctgcggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccattcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggggtgggatggctctcttccctcagccacgccgcttgtgaggacagaggtgggggagtgggaagtgggaagtcaccagagaacaggagagggatttgagggcgagaccccagcgctctccacggaccagccagagggactggagccaggtgtgcatgggttcaaggccctggccctgcccagcctttgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctggggagagcattattcctctgaggagccgctgtgcttccttctgaagtgagggccgtgccccgggtcccatttctcctttcacttgagtcgggaagcacagcaactttaaggctcgcgcccagcaacatggctcccctcgcatctgcatctccctcctgctctggtgttgccgctgcaccctgtcctcggaggacagcagaggtttggacggagactcagggagggagggaaggaggcaaggacgcctgtggaaacatctttcaggcagctctagggtctgggggccaggatgcctgggtctcccaaggcctgtctgctgtctctgccaccctcagcggctgccagaagcagcgtgtgggggaggcatgtgctgcagcacacctgcggccgagaccagcactcagaggtcggctcccctgacaggaaccgtgtagggtgca

SEQ ID NO: 646 - DNA, 2099 bp, Homo sapiens
gccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaagaaaataattgtggattcatcagaagtagtcatacattcagctgatgcatttgcacctgtggcttatctacgctttttagaattgcacttggaggacaaggtgtcctcagtgcctgacaactacagaacatctaattatatatataatttttgaaaagtgttttggaacattgttcattaaaccaccatttctatacaaaaaaattgcatagtattttctcagttactatgactagtttatttttttctcatgactcttatttttttagagaaacatactttcactagaagaggttagtggaaccatttattaattgggaaaatgtcgacggcatgttcattaatagtgccaactttcttggaattcactctttctctttcgttaacacatcttccctatgaccttttttttcttttatttcatctataaaccccatttctgtagcatttctttttttatcacactagtttcttttcctccttctctctttcttgctccaatccctaccaataatgtcatgatgcagaggcatttgaaaatgaagatgaaaagatggtcactttatttagccagtcaagcttattctactgggtgtcgccaaagcgatttatcatttttattttaaatatattcatggttgaagtgtttcaacgttattggacaattaggaagaatgtccttaactcttacaagttattttataactgatttttaaaatgctgtttttcagtattaactatgttgaccttagaaaacttttacaaaaaatagactttatgttttagaacagttttaggttcacagcaaaaatggagcagaaaatgcagagatttcccatataccctctacctccacacattcacagcctcccctaccgtcaatgtcttataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtatatagcttttcatgcagtatatagcttttcagattggcttctttcatgtattaatatgcatttaggtttctctgtatcttgtcatgtatatgtagctcattttttttttagtgtagaataaaattttattgtctggttctaccacatttcatttgtccatgcacctattgaagaacatctcagttgcttccatgttttggcgattatgaataaagcgactataaacatccatg

SEQ ID NO: 647 - DNA, 2369 bp, Homo sapiens
acctcctggctcccgcccgcgctcgccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaagggcatcactagaatgaccttgcttgctgaatatgatgctctgaatctccaagattttcacatgcatttgaaagtgggcagccaggcgattgtttacaggactccaaatgaactgtgcactcacagcaagtttgataaacacacatttcctccttttatcagtgagattgcaaaatgtgaagtatgagtttccagttttactgattcccctcaacccttttcctgtttaaaaacttagacatactaattggatgctgatctgtccctgtttttcattctgcttgctggtagttgacggcttagtttagtacttacctaggcaagatttggcaaaccttcaaaaatgaactttccatgtattcaacttaaaggagattcatcccaaggaatgtaatgtgaacactaattaacattaatgactgctaatcactttgctttttatactcctttaggagcactgctattatccaatgtagttaagtaaaatgcttgtatatgaatcaacaatgttgcatccttttagcagctattgctcacaatcaagctttgcataaattaaagttgactaaaattgattttaatatgctgctcttcttcaatagtaaactaaaatatctagttaaatatcctgcatattaaaaatacattgcctgattttttttgtagtcatcctgtggtagatgaaaagcaatattgcaaatacattttctcacagttcatgacactttctcttagatttcttcaaaattgaacacaactcttcatagtcctatcagcactttgattctgttgtaagcattaattttgttagatcaatgaaaagcaatcagcctatgtttaatttttctgaatttgttcatttacttcctagaggatcttacagattctttagatgatatagtctatttatataaagttggttcataggattgtacattcaacattcattaaaaaaggttgtttattatgtttagtgaattacaggaccattataaaagctttctgtttatttacatgcattcaatgtacctgtgactagaactgccttgccttaggaggaaactaagcaaaacccataaattaataatttaagggagcaatactcaagtagcatttcagttaaaaagtaaagcctcagagtcagtactagccactttagcattgctttactttttgacttttattggctgaaaataacttgttaaactggagcttttgtaataaaatgaaatctacataccatctaaagccccttcccctccttttgatttatgagtaggttgacatattactggagaatttgtaacactttcacagttctgcactttgatttcagagaaggtgctaatctctctggaattttgagagtgacaaaatgagttgtatactgtttttccagggaatttgggttcctttattagaggccttagttttattatggtacctgtattaatgtggatttatccaatatgtgatatggtggtatgattagatatacattaatggaggatttttttttcattgtacatattctacttggtttgatcatattataattctcacagctaatgtccatgtttctacagaggttcagcaattcaggatattattttcaaattaccaaaatgagataatttaactcccttttacttttgcattatttttagtggaaaaaaattaaatggtagtattataagaagctttatgctgtgtatgctagtcttattgtatatatgtactgaaagtacctttgacactgtacttaattggatttaatttcaaagaattgtaacaggaattatgtgagagaatagaaaatatatggaacttaattaagtgctgtccatatgtaaaggtaagattcatgactattgtttgatgtaacttatttattttacatcctgatactgttgtataatagcacaaaatgcatgtctatgaggaaaaacttgctttttctattttactttgagtttttatgtgtaataaaattatgcttaaaatagg

SEQ ID NO: 648 - DNA, 4339 bp, Homo sapiens
ccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggc

SEQ ID NO: 649 - DNA, 773 bp, Homo sapiens
tccttgcctgtgagatggcactgtgacggtgcccacctcgtggggtgtgtgagggccgagtgaaatcgtgcatttgcgctaacgatgagaaccactgcttgagggccttcctatttcttccaccatgcatctggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttggtctgagcaaatggctcattttaaagatgacttgcagacaaatgtagagatcatcccaggggaaagtgccccaagaaaggagagtccaagaccacctgcccctcccagttctgcggctggagtgggtgggtgcagcaaccacagccccagtgtacaggagtcaccactgtctcctcccgcattggcccagcttggaagtgcacagcaaccaagcatgaggactgagttaagcttttcggagaaaaaagacactatgatcatctggcagatcacgatcactgtttggtgccagaggtaaggagtttgcttgttgtgtttgcttggaggcgacagttggcaatgacagcctgggagaagcaccggcagttaacagcactctgcaccactcatgg

SEQ ID NO: 650 - DNA, 1011 bp, Homo sapiens
ggcgcatcctcagggcctgggcctggcctccttgcctgtgagatggcactgtgacggtgcccacctcgtggggtgtgtgagggccgagtgaaatcgtgcatttgcgatgtctaggacacactggatttgtacatctggggctcaggagaggaccagatcagagctggaaatcatgccaggaagagtatgaagcagggagagaaggtgtggaggcctccctgaggaaacgaggggtcgagcaggtgaagagggggctgagagctaaggagtgcacagagacaatgacagaaagacgggaggtctggtttcaggaagggtgtgatggacagaagagatgcagcagaggtcaaggaaggaccaagatgcatcaggaggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttggtctgagcaaatggctcattttaaagatgacttgcagacaaatgtagagatcatcccaggggaaagtgccccaagaaaggagagtccaagaccacctgcccctcccagttctgcggctggagtgggtgggtgcagcaaccacagccccagtgtacaggagtcaccactgtctcctcccgcattggcccagcttggaagtgcacagcaaccaagcatgaggactgagttaagcttttcggagaaaaaagacactatgatcatctggcagatcacgatcactgtttggtgccagaggtaaggagtttgcttgttgtgtttgcttggaggcgacagttggcaatgacagcctgggagaagcaccggcagttaacagcactctgcaccactca

SEQ ID NO: 651 - DNA, 1725 bp, Homo sapiens
gataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcaagtt

SEQ ID NO: 652 - DNA, 1608 bp, Homo sapiens
aaggagctaatggacaggcaagggtggggcctgtaggataagagagcttggaagggattgttcgaggatgtgggatttggtcttagaagaccgaaggatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcaagtt

SEQ ID NO: 653 - DNA, 1771 bp, Homo sapiens
aaggagctaatggacaggcaagggtggggcctgtaggataagagagcttggaagggattgttcgaggatgtgggatttggtcttagaagaccgaaggatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcaagtt

SEQ ID NO: 654 - DNA, 1644 bp, Homo sapiens
gataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcaagtt

SEQ ID NO: 655 - DNA, 1554 bp, Homo sapiens
tttgactggagtgaggtctcatgtctgcttatgcggtggctcgctgctcagaacagggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggaaccattggagatactcattactctttgaaggcttacagtggaatgaattcaaatacgacttatttgaggaattgaagttgactttatggagctggacatccactcggcgcaggttcccctgccagtaggaaggggacgtcacagggatgccaccccagagagcaaggggtctctccaggacctgggctggagtgcagtggcgcaatcacagctcactgcaacttcgacctccccggctcaagtgatccccccgcctcagcctcgctggtctcgaactcctggcttcaagcgatgctttcgcctcggcctccacaaagtgctgggttcacagtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtca

SEQ ID NO: 656 - DNA, 1622 bp, Homo sapiens
taagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatatt

SEQ ID NO: 657 - DNA, 6420 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctg

SEQ ID NO: 658 - DNA, 8103 bp, Homo sapiens
cctgcggcgctggagccttgacgcacggagctcgagagcgagaacgggagagaaaggggtagaaatggcggctccgctcggctcccgctgaggagggcgaagccggcggagtgtctgtgctgccggtctgcagcaccgcccccgcttcccgcacgccgcctgctcacgccgacttcccttcctctgcccggctctctcttgtgctcgtctgcgctccgcacgctccgggccggctcgtctctcattgcccggctcggctccgctggccctgactgaccggccggcgggccggccttgctcggctctcccgggcgcggcgtggactccgtccccctggctggaccatggtgaacacccggaagagctctctccgccttctcgggtccaagtctcctggtcccgggcctgggcctggggccggagcagagcctggggcgaccggaggcagcagccatttcatctcctctcggacccgctcctccaagacccgcgccgccagctgccccgccgccaaagccgggggaagcggtggcgccggcgtcactctggatgaggccaggaaagttgaagttgatggtagtttaagtgatagccacgtatctcctccagccaaacgcactttgaaacaacctgattctgtttgcaaagacaaatcaaaatcacgaagtactggtcagcgagaggaatggaacttatcaactggacaggccaggttaacttctcagcctggtgctacattaccaaatggacatagtggcttatcccttcgaagccatccccttcgaggggaaaagaagggagatggggacctttcttgtataaatggtgacatggaagtcagaaaaagttgtcgttccaggaaaaacagatttgaaagtgtgaaccagagtttgttatttgatcaactagtaaatagcactgctgaagctgtactacaggaaatggacaacattaacatccgacagaatcgtcgatcaggagaagtagaacgacttcgaatgtggacagatacagaatttgaaaacatggatatgtattcaagagtgaaaaggcgaagaaagtcactaagaagaaatagttatgggatacaaaatcatcatgaagtttctactgagggtgaagaagaagaatctcaagaggaggatggagatatagaagttgaagaggcagaaggagaagaaaatgatagaccatataatttgagacagagaaaaacagtggatcgataccaagcacctccaatagtaccagctcatcaaaaaaagagggaaaacacgctgtttgatattcatagatctccagcaagaagaagccatattaggagaaagaagcatgccattcatagtagtgacacaacttcttctgatgaggaacgctttgaaagaaggaaatcaaagagcatggcaagagcaagaaatagatgtttgcctatgaacttcagagcagaggacttagctagcggtattctccgagaacgagtgaaagtgggtgcaagcttggctgatgttgatccaatgaacattgataaatcagtacggtttgatagcataggtggattgagccatcatattcatgcgctaaaggaaatggtagtattcccacttttatatccagaaatttttgaaaagtttaaaattcagcctccaaggggctgtttgttttatggccctcctggcacaggtaaaaccttggttgccagagcattagctaatgaatgcagccaaggagacaaaaaagtggctttttttatgcgaaaaggagcagattgtttgagcaagtgggttggtgaatctgaaaggcaacttaggcttctttttgatcaggcatatttgatgagaccttctataatattttttgatgaaatagatggattagctccagttcgctctagcagacaagatcagatccacagctctatagtatcaaccctccttgctcttatggatggattagataataggggtgaaattgttgttattggtgctacaaacagacttgactctatagatcctgcactcaggagacctggtcgttttgacagagaattcctcttcaacctgcctgatcaaaaggcaagaaaacacatcttacagatccataccagggactggaatccaaaattgtcagatgcatttttaggtgaattggctgaaaaatgtgttggctactgtggagccgatatcaaggccctgtgcactgaagccgccctgattgcactgcggaggcgttatccccagatctatgctagcagtcataaactgcagctggatgtttcctcaatagtgcttagtgcccaagatttttaccatgcaatgcagaatatcgtgcctgcttcccaacgtgctgtgatgtcttcagggcatgcactatcccccatcataagaccactgctggaaagaagcttcaacaacatcctagcagtcttgcaaaaagtgtttcctcatgctgaaattagccagagtgacaaaaaagaagatatagaaactttaattttagaggatagtgaagatgaaaatgctttatcaatttttgagaccaattgtcactcaggatcaccaaagaaacagtcatcatctgctgctatacataaaccctaccttcattttacaatgtcaccatatcatcagccaacctcttacaggccacgcttattgctctctggagaacggggctcaggtcaaacttctcaccttgctccagcacttttgcacactctagaaagattctctgtgcatagactagatctcccagcactttattcagttagtgccaaaacacctgaggaatcatgtgcacagatttttcgtgaagctcgaagaacagtacctagtattgtttacatgcctcacattggggattggtgggaagctgtcagtgaaactgtgagagcaacttttctgacattgctacaagatataccatcattttcacctatatttttattgtctacctctgaaaccatgtacagtgaactgcctgaagaggttaaatgtatctttagaatacagtatgaagaggtcttgtatattcaaaggcctattgaagaagacagaagaaaattttttcaagaattgattctcaatcaggcatcaatggctccaccacgaaggaaacatgctgctctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtggatattgaagaggtttcagattatcttgaagtaatcaaggaaccaatggacttatcaacagtaataactaaaattgataaacataattacctgactgcaaaggatttcctgaaagatattgacctcatctgtagcaatgctttagagtataatccagataaggacccaggagataaaataattaggcacagggcttgtaccctgaaggacactgcacatgctatcattgcagctgaattagatccagaatttaataaactttgtgaggaaattaaggaagcaagaataaaaagaggcttatcagtaacatcagaacaaataaatcctcatagtactggagctcggaagacagaaactagagtcgaagaggcatttcggcacaaacaaagaaatccaatggatgtgtggcacaactctgcaaataaatgtgcatttcgggttcggagaaaatcaaggcggagatcacagtggggtaaaggaattattaagaaaaggaaagttaataatttaaaaaaagatgaagaagacaccaaatttgcagactatgagaaccatacggaggacaggaaattattagagaatggagagtttgaggtaagcactgactgccatgaggaaaatggagaagagactggagacttatctatgaccaatgatgaatcatcctgtgacatcatggacttggaccaggggcagaggcttaacaatggagcaggcacaaaagagaactttgcatctactgaggaggaaagttcaaatgaatctctactggtcaacagcagcagttccttaaacccggagcagacctccaggaaagagactttccttaaaggaaattgtctaaatggtgaggcttccactgacagttttgaaggaataccagttctggaatgtcagaatggcaagcttgaagtagtttctttctgtgatagtggagataaatgtagttctgaacaaaagattcttctggaggaccagtcaaaagaaaaaccagaaacttcgactgaaaatcatggagatgatcttgagaaactagaggcactggaatgtagcaataatgagaagttagaacctggctctgatgtggaggttaaagatgcagaactggataaagaaggtgcttctaaagtaaagaaataccgtaaattaattttagagcaggcaaaaacgacaagcctggaactggttccagaagagccatctgagcctgtgcctcctcttatagttgatcgtgagagattgaagaaattgcttgatttgttggtggataaaagcaacaatctggcagttgatcagcttgagagattatattctcttcttagtcagtgtatctaccgtcatcgtaaagattatgacaaatcacaacttgtagaggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaaccccacagcttggagattttggtgctacagaaactgctctcgcttctgctcctctttttgtgcactctcttttggagactcctctcttagggagcagaccagcaaacaggaggaaactggatgggggcagttctaactgtgttgaattgtttaaacagtgggcaacttgttatttttttttcctccattttacccctttaatcatatttttcccccatctgggtaatggactgaaacctgttttagagttggctatggtctgttctggtgggaagctgaagaaactggatgaaattaggtcaggctctttagaactgcctttaacgtgcctttttattcatttgaggaagataaggctaaaaggatgggctgtttgaagcaaataaattagaaatatttctttggtcacaaccttgaaaataagttttgatactctatgtcattaagagacaaccagtgtttgggtatgaaatgcctgtcttattctcaaagctcaatcaagacacccagtaagccacataatatactaaaatggtaagttttcttgtaaggtctgttttggtttaagaaacatgaataacaacaaagaataatacacagtccacacacaaaaaaacaaaaaacaaaactgcacacgttttggtattgccaacaatgatgactagaaaataaatagatagtggccattttttcttctgtcagtggcaatttaatagttattcatgtttgagttcccagagaaaaatggttttcatatgtagtaaattgttgttttgttttaaagccaggacttgccaaatggacagaaaagagaggaattcatcagaagctccataaaattcattttctgtatgcttaattgcaaacgagctctggtatggtccttgaataacagtattaatgtttaaatcccatctcctaagcttaccttcacaactcttctttttgattggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaatttgtacaattaattaagattttagccatcagtgagtttgaaaagggaaatgtatttattttcagcattaaaatgcttccaaaagatcaagttgcttttgtttgtttgtttttttaaccgtaatgtagatggagaaattggaggcaacctcagtataggaactgccactttgaacagtttaggtcttaaagagaaagtcaatctaatgccaaggggagaacaatgagctgaaattgtaccaactcctctggccctccttccctcaattaaaaaaacacacttaccagttttgcttattttacagatatctggtggttctatagtttaaagcagcttgtgaaattaaaaaagtggactcaattttgtttacctttctgtaagtttttcatttttgctgtatagcattggcaaaaatatgtacaaattgacctctgttcttatttcctattgtgagcattataaagataagctcctatgtaaaaccttgctctcagatgagtaaaatatgtatcacagcatagctcagcaataattcatgctcagctgtggggaccctgggggctttttgaagatgatggaaccgcactagggttgaaactgatggctgtggagttaattgtgttttcgagcttgaatctcacctgtgattttttttttttaatgttgtttcatgacttgatttttctcataagccaatgtatttgtaggtttactggattttatttttagggagtgggtaatttcttcccttttttgattaagttggttcagctatggtgctattcagtaggtatcttcagtgtcaggtcccgtagctgaatgccattgttattataattattatttgtaatcacattgtaagcttgaatttgggcttgtacctgcatcttttgtattctgtacatctggttacttagactttgggagtccaatttggtttcagtcatgtatgtctactttgtagtttaagtagacttcatcaactatggtctattttgggtttgtagttttaatttagaattgtgttaaattgatgttttgcatttgacttcatttgacattagttgaagtaaattatttaatttttgaattctggaatttgaacatttactgtaatttgtaatataactgctgtgaaatacttgaataaagatgacaagaaaaaca

SEQ ID NO: 659 - DNA, 1413 bp, Homo sapiens
aaggggtagaaatggcggctccgctcggctcccgctgaggagggcgaagccggcggagtgtctgtgctgccggtctgcagcaccgcccccgcttcccgcacgccgcctgctcacgccgacttcccttcctctgcccggctctctcttgtgctcgtctgcgctccgcacgctccgggccggctcgtctctcattgcccggctcggctccgctggccctgactgaccggccggcgggccggccttgctcggctctcccgggcgcggcgtggactccgtccccctggctggaccatggtgaacacccggaagagctctctccgccttctcgggtccaagtctcctggtcccgggcctgggcctggggccggagcagagcctggggcgaccggaggcagcagccatttcatctcctctcggacccgctcctccaagacccgcgccgccagctgccccgccgccaaagccgggggaagcggtggcgccggcgtcactctggatgaggccaggaaagttgaagttgatggtagtttaagtgatagccacgtatctcctccagccaaacgcactttgaaacaacctgattctgtttgcaaagacaaatcaaaatcacgaagtactggtcagcgagaggaatggaacttatcaactggacaggccaggttaacttctcagcctggtgctacattaccaaatggacatagtggcttatcccttcgaagccatccccttcgaggggaaaagaagggagatggggacctttcttgtataaatggtgacatggaagtcagaaaaagttgtcgttccaggaaaaacagatttgaaagtgtgaaccagagtttgttatttgatcaactagtaaatagcactgctgaagctgtactacaggaaatggacaacattaacatccgacagaatcgtcgatcaggagaagtagaacgacttcgaatgtggacagatacagaatttgaaaacatggatatgtattcaagagtgaaaaggcgaagaaagtcactaagaagaaatagttatgggatacaaaatcatcatgaagtttctactgagggtgaagaagaagctagaacctctaaattgcttcctttggagaaaatcagtatagaatctcaagaggaggatggagatatagaagttgaagaggcagaaggagaagaaaatgatagaccatataatttgagacagagaaaaacagtggatcgataccaagcacctccaatagtaccagctcatcaaaaaaagagggaaaacacgctgtttgatattcatagatctccagcaagaagaagccatattaggagaaagaagcatgccattcatagtagtgacacaacttcttctgatgaggaacgctttgaaagaaggaaatcaaagagcatggcaagagcaagaaatagaaaa

SEQ ID NO: 660 - DNA, 3766 bp, Homo sapiens
attttggcattgttcttcgagcagcgtgcattttggtagacactagccgtatgtggctattgagcacttaaaatgtggctagtgtaactaaagaactgcattttaaattttatttagtcttagttaatttaaaatttaaataaaatggcattatgtggctcatggcttactatattgcacagcatggatcttgaacatcgttttccacattaactttccctttctaacatttcgaggaaacagttttgtgagactgaaatctaagtcattcttctcaagcctgggtctgtggaaaggcctatgctggctgtttacctttttcccttaaatagtttttaaggtcccgagactagatgagattaccaagtcttctctcttacagagcagtcagtaaggcaagaaaacacatcttacagatccataccagggactggaatccaaaattgtcagatgcatttttaggtgaattggctgaaaaatgtgttgggacctccatctccgaagcagcatccctcagcttttgaaccacaaagacctcgacatcttctggctactgtggagccgatatcaaggccctgtgcactgaagccgccctgattgcactgcggaggcgttatccccagatctatgctagcagtcataaactgcagctggatgtttcctcaatagtgcttagtgcccaagatttttaccatgcaatgcagaatatcgtgcctgcttcccaacgtgctgtgatgtcttcagggcatgcactatcccccatcataagaccactgctggaaagaagcttcaacaacatcctagcagtcttgcaaaaagtgtttcctcatgctgaaattagccagagtgacaaaaaagaagatatagaaactttaattttagaggatagtgaagatgaaaatgctttatcaatttttgagaccaattgtcactcaggatcaccaaagaaacagtcatcatctgctgctatacataaaccctaccttcattttacaatgtcaccatatcatcagccaacctcttacaggccacgcttattgctctctggagaacggggctcaggtcaaacttctcaccttgctccagcacttttgcacactctagaaagattctctgtgcatagactagatctcccagcactttattcagttagtgccaaaacacctgaggaatcatgtgcacagacaaaattactgcaggttgtatgcaagtaaaagaattactcagtaccatttaaaataaatacaaatgatttagtagaaaaatataaatcaacaaaattgaccccagagaagagagaatctaaacaatcactgtggaagaagaaattcagcaagtatcttaaaaccactaaacatagatggtttcacaggtgaattattttaatcttaaaggataagatcattttgatgctagtcacactgttccaacagcataggaataaaataatccttggatttccaagatccaggataggagggtacgtgtttgcagaaaaggtcaaaatttgagagtcctgaaggagttgtactgtacaactgttctggattggtggatatgcaaatattaaggaagggaaggagcaaatattacttttgatatttttcgtgaagctcgaagaacagtacctagtattgtttacatgcctcacattggggattggtgggaagctgtcagtgaaactgtgagagcaacttttctgacattgctacaagatataccatcattttcacctatatttttattgtctacctctgaaaccatgtacagtgaactgcctgaagaggttaaatgtatctttagaatacagtatgaagaggtcttgtatattcaaaggcctattgaagaagacagaagaaaattttttcaagaattgattctcaatcaggcatcaatggctccaccacgaaggaaacatgctgctctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtggatattgaagaggtttcagattatcttgaagtaatcaaggaaccaatggacttatcaacagtaataactaaaattgataaacataattacctgactgcaaaggatttcctgaaagatattgacctcatctgtagcaatgctttagagtataatccagataaggacccaggagataaaataattaggcacagggcttgtaccctgaaggacactgcacatgctatcattgcagctgaattagatccagaatttaataaactttgtgaggaaattaaggaagcaagaataaaaagaggcttatcagtaacatcagaacaaataaatcctcatagtactggagctcggaagacagaaactagagtcgaagaggcatttcggcacaaacaaagaaatccaatggatgtgtggcacaactctgcaaataaatgtgcatttcgggttcggagaaaatcaaggcggagatcacagtggggtaaaggaattattaagaaaaggaaagttaataatttaaaaaaagatgaagaagacaccaaatttgcagactatgagaaccatacggaggacaggaaattattagagaatggagagtttgaggtaagcactgactgccatgaggaaaatggagaagagactggagacttatctatgaccaatgatgaatcatcctgtgacatcatggacttggaccaggggcagaggcttaacaatggagcaggcacaaaagagaactttgcatctactgaggaggaaagttcaaatgaatctctactggtcaacagcagcagttccttaaacccggagcagacctccaggaaagagactttccttaaaggaaattgtctaaatggtgaggcttccactgacagttttgaaggaataccagttctggaatgtcagaatggcaagcttgaagtagtttctttctgtgatagtggagataaatgtagttctgaacaaaagattcttctggaggaccagtcaaaagaaaaaccagaaacttcgactgaaaatcatggagatgatcttgagaaactagaggcactggaatgtagcaataatgagaagttagaacctggctctgatgtggaggttaaagatgcagaactggataaagaaggtgcttctaaagtaaagaaataccgtaaattaattttagagcaggcaaaaacgacaagcctggaactggttccagaagagccatctgagcctgtgcctcctcttatagttgatcgtgagagattgaagaaattgcttgatttgttggtggataaaagcaacaatctggcagttgatcagcttgagagattatattctcttcttagtcagtgtatctaccgtcatcgtaaagattatgacaaatcacaacttgtagaggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaacccc

SEQ ID NO: 661 - DNA, 3859 bp, Homo sapiens
cttcatgattaactccccaaggtcctgcatattttctcaatgggccaccgcgcccggccagaagatttttatggtaaaattttgtgatgggaaaactcatcccggaaaatgttgagacctgatgctgagtcctcagcagctcagagaatacgtacttctgtcccaggtcacccaaacattgacctgtgtcggttccccactaggaacaaaatgtaactgaggacgttgtcagatgcttgtcctcgtcaccctgagcttgttggctgctatctaattcttattctttcattttcttgcccgcacgttcttgatagcagatcactgacaacagccattggaagcttaggaaaagggtatgtgccgggcgcggtggctcacacctgtaatcccagcactttgggaggctgaggtgggcggatcacgaggtcaggagatcgagaccatcctggctaacacggtgaaaccgtctctactaaaactacaaaaattagccgggtgtggtggcggtcgcctgtagtcccagctactcgggaggctgaggcaggagagtgacgtgaacccgagaggtagagcttgcagtaagcagagatcatgccactgcactccagcctgggccagaatgagactccgtctcaaaaaaaaaaaaaaaaaaagcatgtgtaacgtgaaaaaatggacactttagccatcgcctgactttctgttgaattgggaaagagcctcctcccgtccacatgggatggccttcctgatgtggctctccaagaccatccctggagggcataaaacctcacaaatgcatcaggccgtgtgctggggatggggcatcgtcacgccaggtctgactaggaaggaggatggggaggcagggctgggggctttgaggtcgaggcgtggccgtggattccagaaagccccttggctggtgtgcgtgcctgcccagcggcatccgtgtatcctaacacctgccctccgtgtccctgcatctgcaggccatgtcaaaggacgccctgaatctggcgcagatgcaggagcagacgctgcagttggagcaacagtccaagctcaaacaacttgtcaatgaggatttacggaagcaggaggagtccgtgcagaagcaccatcagaccttcttggagtccatcagggcggctggcaccttgtttggggaaggattccgtgcctttgtgacagaccgggacaaagtgacagccacggtggctgggctgacgctgctggctgtcggggtctactcagccaagaatgcgacagccgtcactggccgctacatcgaggctcggctggggaagccgtccctagtgagggagacgtcccgcatcacggtgcttgaggcgctgcggcaccccatccagcaggtcagccggcggctcctcagtcgaccccaggacgtgctggagggtgttgtgcttagtcccagcctggaagcacgggtgcgcgacatcgccataatgacaaggaacatcaagaagaaccggggcctgtacaggcacatcctgctgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccactgagaagataagcgaggacctcagggccacactgaacgccttcctgtaccgcacgggccagcacagcaacaaattcatgctgatcctggccagctgccaccccgagcagttcgactgggccatcaatgcctgcatcgacgtgatggtccacttcgacctgccagggcaggaggagcgggcgcgcctggtgagaatgtatcttaacgagtatgttcttaagccggccacagaaggaaagcggcgtctgaagctggcccagtttgactacgggaggaagtgcttagagatcgctcggctgacagagggcatgtcatgccggaagatcgcacagctggccgtgtcctggcaggccacggcgtatgcctccaaggacggggtcctgaccgaggccatgatggacgcctgcgtgcaagactttgtccagcagcaccagcagatgatgcgctggctgaagggggagaggcctgggcccgaggacgagcaaccctcatcctgagtccatggggagaccacacctcacggagcctggccgcggacccctcccacccctgcctttgcggccccgcacatttaggaaatactccccgtaataaagtcccacgggggccgcaccgctgtgtctattggctgacacggggcggggtttggggccccctaacgtccccctggggtcaaaggtgacagaaaaggcagaagctggggctttctggaggatttaaccacagaggggtgggcttcacaggaggtggctgccacggcggggccgggtgcccgtgccccatcctgaggccgtgcatacgcgggtgccccttcgcctccctcccctccgccagagctgcctgtggccagacacacggtggagggaagtgcacgcgaaacagacacagcggcttcaaatagatgccgcccctgcccgcgctttgcagctagtccctgcaaaccttgatgatggggctgggcgcggtggctcacgcctggaatctcagcgaggccaaggagagtggatcacctgaggtcgggagttccagaccagcctggccaacatggtgaaactccatctctcctaaaaaaaaaaaaaaaaaaaaaaaaaaaaaaaaaaaaattagccggccgtggtggcaagtgcctgaaatcccaggtactcaggaggctgaggcaggagaatcacttgagcccgggaagtggaggttgcactgagctgagaccatggaattgcactgcagcatgggcaacaagagtcaaactccctctaaaaaaaaaaaaaaaaaaagggccaggtggcacatgccggtggtcccagcttcttggcttggaggctgaggtaggaggatcgcctgagcatgggaggcagaggttgcagtgagccaagatcgcaccattgcactccagcctggatgatagagtgagactgtacctctaaataaccaaaaccttgattacagccatggggtgggggtgggggtcaggggcgtctgactatggctggggaactcatttggtttttctcctctcttatttttttgggtagagacagggtccctttgttgcccaggctggtctccaactcctgggctcaagcaatcctcctgcctcggcttcctaaagtgttgggattacaggcttgagccaccgtgcctggtctgttttttttttttttttggcaatagagtcttgctcgcccagggtggagtgcagtggtgtgatctcggctcactgcaacctccaccttcagggtgtcaggcctctgggcccaagctaagccatcatatctcctgtgacctgcacttatacatccagatggcctgaagcaactgaagatccacaaaataagtgaaaagagccttaactgatgacattccaccattgtgatttgtttctgccccaccctagctgatcaatgtactttgcaatctcccccacccttaagaaggttctttgtcattctccccacccttgagaatgtactttgtgagatccatcccctgcccgcaaaacattgtccctaactccaccgcctatcccaaaacctgtaagaactagtgataatcccaccaccctttgctgactctctttttgaactcagcccgcctgcacccaggtgaaataaacagccttgttgctcac

SEQ ID NO: 662 - DNA, 2453 bp, Homo sapiens
acagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 663 - DNA, 2624 bp, Homo sapiens
agactcggcgcctctcctcaaggccccgctcgccccgcccaccgggctctgcgcactccgctcctttcctgcgtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctc

SEQ ID NO: 664 - DNA, 4293 bp, Homo sapiens
gacgccatactggacgccaagtgggaggaacttcaaggctgtcccctgcgggcctcccgctctgcttctgcgaaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctctt

SEQ ID NO: 665 - DNA, 4290 bp, Homo sapiens
ccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctctt

SEQ ID NO: 666 - DNA, 6173 bp, Homo sapiens
ctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttctgtgacagtgacagtgaccaggaagagaaggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagacatccaaccctatcgatgtcgctgctcggcctgggacagtcccacacactttactccaaaaggacccgaggttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcacccca

SEQ ID NO: 667 - DNA, 957 bp, Homo sapiens
agcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttcagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttca

SEQ ID NO: 668 - DNA, 5950 bp, Homo sapiens
cgctcgcagtttcgccctctcttccgctaatgattgcattattatgctcccctctctggggggtctcgcccctcttgggtcgctccggagccccggcctcccctggctgcatttcttaaaaatttgggagcctgggagtgagttttctccgaggcgtgtgtgagaggcggcgggggtgttttcctgcgcgaggggcgggtgaagttcattgcccccacttttcccgcgacctttttcggacccgattttggatcgagttgaggggggcgcgggcgttttcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttctgtgacagtgacagtgaccaggaagagaaggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaa

SEQ ID NO: 669 - DNA, 3111 bp, Homo sapiens
actggcctggcccgcggcaggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagtgagcggatgctgggcgggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaagatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgagaaacatgatataggagttgcgcgattggagctagatgcgattgaactgacaaggaagttgtaccaatactccagctatttgagcagttgttgcaaagggatggtaacagcaatggctctgagtaaatccactaactcacacaaaaatgctactgaagacctttatgaggtggataagttgaagaaagaatgttatgaatggatcaacacatgctcttgcctcctttctaatatcaaaggcagaaaaattacattattgacatatgaagaaatagagcggctacttgaagaggaggctgtaaaagaattcattgagcctgaaatagacgagtcttttaaagaagatgaagaagaaagtaaggaggataggaaacttcaggaggaaaataaagagagagcagaagaacaaccttcaacatctacagagaaggaaaaactcattcgattcattggagaagatgaaaatgttcattccaaacctctatttgaaacagatgtgttgtcttcctggaagaacatt

SEQ ID NO: 670 - DNA, 3420 bp, Homo sapiens
actggcctggcccgcggcaggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagtgagcggatgctgggcgggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaagatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgagaaacatgatataggagttgcgcgattggagctagatgcgattgaactgacaaggaagttgtaccaatactccagctatttgagcagttgttgcaaagggatggtaacagcaatggctctgagtaaatccactaactcacacaaaaatgctactgaagacctttatgaggtggataagttgaagcaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaa

SEQ ID NO: 671 - DNA, 3642 bp, Homo sapiens
actggcctggcccgcggcaggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagtgagcggatgctgggcgggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaagatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgagaaacatgatataggagttgcgcgattggagctagatgcgattgaactgacaaggaagttgtaccaatactccagctatttgagcagttgttgcaaagggatggtaacagcaatggctctgagtaaatccactaactcacacaaaaatgctactgaagacctttatgaggtggataagttgaagaaagaatgttatgaatggatcaacacatgctcttgcctcctttctaatatcaaaggcagaaaaattacattattgacatatgaagaaatagagcggctacttgaagaggaggctgtaaaagaattcattgagcctgaaatagacgagtcttttaaagaagatgaagaagaaagtaaggaggataggaaacttcaggaggaaaataaagagagagcagaagaacaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaa

SEQ ID NO: 672 - DNA, 2714 bp, Homo sapiens
aagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagtgagcggatgctgggcgggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaagatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatgagacaggatctcaccgtgttgcacaggctggtctcaaacttctgggttcaagcgatcatcccacttcagccccccaaagtgctggaattagaggcataatccaccgcacctggccttgggttaatttttatatagtgtgtgaggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgag

SEQ ID NO: 673 - DNA, 586 bp, Homo sapiens
aggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaa

SEQ ID NO: 674 - DNA, 510 bp, Homo sapiens
aaaggaggaagtgagcggatgctgggcgggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagg

SEQ ID NO: 675 - DNA, 120 bp, Homo sapiens
atggcagccggagcggtttttctggcattgtctgcccagctgctccaagccagactgatgaaggaggagtccccagtggtgagctggaggttggagcctgaagatggcacagctctgtga

SEQ ID NO: 676 - DNA, 144 bp, Homo sapiens
atggcagccggggcggtttttctggcattgtctgcccagctgctccaagccaggctgatgaaggaggtgtcccctgtggtgagctggaggttggagcctgaagatggcacagctctcagtggggtctcactctgtcgcccaggc

SEQ ID NO: 677 - DNA, 593 bp, Homo sapiens
gcagaaatgcctctcccatgggactaccctgaagccccatggaggcgtctccacagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccag

SEQ ID NO: 678 - DNA, 10341 bp, Homo sapiens
atggatggccgcgactttgcgccgccgccgcatctgctgtcggagcgcgggagcctgggccaccgcagcgccgctgccgccgcgcgtctcgccccggctgggcccgccgcgcagccccccgcacacttccagccgggaaagtacttcccgtcgccgttgcccatggcttcgcacacaggatcagccaggaaaatgggcagttgccctgccccttccttccttccttccttccttgagaggcctctctacccagcacccacgaagacggtatcagggccttctctgaggccccccacagcagccatacgctccccaaccccagactgtgcccagaagtggtcccagaacgctcatgaggctccggggtaccccagattttcggggagtctggcatccaccttcctacccgtgagccacttggatcaccatggaaacagcaacgttctctatgggcagcaccgtttctatggaacccaaaaagataacttctacctgcgcaacctgccgccccagcccacgctgctgccggccaaccacaacttccccagcgtggcccgggccgcccctgcccaccccatgggctcctgcagccgggatcgagaccggggtgaggcaggctccctgcagaagggccccaaggacttcgaccgcttcctcgtgggcaaagagctgggcagagagaaggcgggcaaggccgctgagggcaaggagcggccagcggcagaggaggacggtggcaaggagcggcacaagctggtgctgcccgtgccagccgacgggcactgcagggagggcggccccgcaccccgaggggcctgcgagggccgccccaagcacctcacctcctgcctcctcaacaccaaggtgctcaacggcgagatgggcagggctgcgctagccagctgtgcagggggcatgctggggcggcctggcacgggggtggtgacctccgggcgctgtgcaaaggaggcagcaggccccccggagcccgggccggccttcagcgagtgcctggagcggcggcagatgctacaccacaccgcatcctacgccgggccacccccgcccctcagcacagccgccggctccttcccctgcctgcagctgcacgggggccctgacgggctctgcccgctgcaggacaaagccccccgggacctaaaggccagcgggcccaccttcgtgccttctgtgggacacctggccgacaagggccgccccttccaggccgccgaggcctgtgccgtggcaggggagggcaaggaccggcacctggagggaaccatggcccccgaccacgctgcaccctatggagtctcctatgcccacctgaaggccgagggcaagggcgagcggcggcctgggggctttgaggcggccctcaacccccggctaaagggcctcgactatctcagcagcgcaggccccgaggcctccttccccggactccctaaaagcggtctggacaaaagcggctacttcgagttgcccacctcttcacaggactgtgcccggcctggtcaccaggacccgctgggcgggaaggccccccaggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtggcggtgggccccgttccacacacgcgctggacctggaggctgaggaggagaggacgaggctatgtgatgaccgcctggggcttgccagccgcgagctgctgctgcaggacagcaaagaccgcgtagagttcgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctaccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctagccttcaacctgcagcacctggccacgctggccacagcctggtccctggtggaggccgctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccggctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacaccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcatcgagggcgagaggggcaaccggcagaggatctactcactggagcagctgctgcaggaagcggttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgcccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgccccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagggaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgtaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttctttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 679 - DNA, 1860 bp, Homo sapiens
ggcggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctggg

SEQ ID NO: 680 - DNA, 1405 bp, Homo sapiens
ggcggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacaggtgagaagcagcccagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgca

SEQ ID NO: 681 - DNA, 617 bp, Homo sapiens
atagtgtagcatgaagagctaaatttagagggaagtggggcctctgctccaaatagtaacagctaaaggatagacactcttggagagcagaatatctttatttagtctgtcaccaccagtggaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcac

SEQ ID NO: 682 - DNA, 1862 bp, Homo sapiens
ggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacaggtgagaagcagcccagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggcttttt

SEQ ID NO: 683 - DNA, 674 bp, Homo sapiens
agtttctttccaaaatggagagaactaaagaagagtcccagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaa

SEQ ID NO: 684 - DNA, 859 bp, Homo sapiens
cagtcattcccttgtagggacaactagaagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggag

SEQ ID NO: 685 - DNA, 993 bp, Homo sapiens
attgtctgccgccactgctgctgctgctgctgctgccgctgctgctgcacgaatcgccgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgat

SEQ ID NO: 686 - DNA, 4703 bp, Homo sapiens
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttttttttttttttttgtatttttagtagagatggggttttaccatgttgcccaggccggtcttgaattcctgtcctcaggtgattcatttgcctcggcctcccaaagtgctaggattacaggcgtgagccactgcacccagcccaaatgagatgtttctaaatctaaagtttcttctgcttctgcatttctgtgaatctcatttgaaatttttcagggaagggattttatcatttgttcagagatgtctttatttttattaatacccataaaacgtttgtgtatttgcttcttcctctttctccttttgatcacattttagctacttatctagaggatctctggccaagtattcccttttattgtattgataacaattcttaatggctggcctctcttgtgtacaatgagccaatattcttttttgttctatatttttgtatcttcccctttcctgaacaaagcatatttagagtctcaaagaaatcctctccacaaagacatgttcctccctctggtgtgggtagacatagggtaagagtttggatgaaacttttgtaaattgtagtgttcttggcataaatatgaattaaatctttttttatatttaaataactagttaaatatgtgcttcttactaagattaggtattttttgccaagataacaatgataaaaacattttgggggggaaattgaccttaaaattttgggataattcaagaaatgtctgcagaaaattgatttatgatcttaatttttgtgttagtcctttgaggtttttttgtttttgtttttgttctttgtaaagcgccttatctgttttggacaagtccaaagtaaatggttgggctcttatatctgttttacccttatttttcccattaagtaatggtttaagaatatatcaagcaccttaatttgttgttaagtagctagtgcttacaggattccattaaattcactttaataagcctatgaagttcttatgaaaaacccatatctgcgatatgtttgatttgtttctttgttttaattcagtgtttaaccctaggtatgctacatacccataaataagataccatggtaagagatagtatgttatagtgggaaaagcacaagtttttagatagagatcaattctgctatctacccttacattgtaacctttctgacagggctgctgcggtgcacaacttcgggagccatcacttatttttgttgtgttccagaaggtgtcattttcatagactgcagtgtgaatagtgtcctccattaataatgcaatgatggccttgctctctgagcctcagttttatctataaaatggtacctagaagagtcatgatttcttagaatcccctaaattattaaggtgaaggtagaagatgattaaagcgtgttatctcctaagctatggcttagattttccgaagctcatggttctaggcacagaaagtctccattctacactgcatttcaacctgtgttgaacaacactccagttcagcctgtattgctatgccacatagagtttgcctgaattattatagctttcttaatagttttgtttatgatccactctctccagcccattacacaggagccagctacctaaatttcctatctgagcatgtccttacatttacttccagcatactattcatttgccatagtagagtattaagattatttgattttctttttactttctcgtagtgcccaatgtgtagtttactcaacatcataatatgtaatgtttttcaactacttactgttgaatacaaagttatctcatttaa

SEQ ID NO: 687 - DNA, 2159 bp, Homo sapiens
gtctttctctgtctcggctgaggcagccatctttctcttgccgcgtgctggtgttggaggaccctccctgcttcagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttg

SEQ ID NO: 688 - DNA, 383 bp, Homo sapiens
ggggcaacagctgagccgtctgggaagggatgcatctatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaa

SEQ ID NO: 689 - DNA, 727 bp, Homo sapiens
agggtgacgtagatttttttccttcgccagtctcaccgttacccggggcaacagctgagccgtctgggaagggatgcatctgaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattcca

SEQ ID NO: 690 - DNA, 2119 bp, Homo sapiens
tcggaagttactgttgaagctaaggcggccataactgataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaatggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccaataaagaatcaatactgcttca

SEQ ID NO: 691 - DNA, 492 bp, Homo sapiens
ggggcaacagctgagccgtctgggaagggatgcatcttttcttctgtatgcttgagtcaagaactctaagtcatcttggtaataccgggttggatgcttaaagctgcagcaaaaagaccagaactttcagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaaca

SEQ ID NO: 692 - DNA, 812 bp, Homo sapiens
agggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcagggcttctcaaatttaataactatggaatcttatcagaaagtccattaacatctcaaagaacaacgtggttattgtatcaatcaccatcctttataccaggatttgcatatccttcaagatgcctgaagacaatcggaggggtatacaagcaagcgaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgttttt

SEQ ID NO: 693 - DNA, 1502 bp, Homo sapiens
ggcttccggttccgccacggcccagaggctgtgttgaggctaatggcggtgcccacggaactggatggagggagtgttaaggagaccgcagcggaagaggaatcgcgagttctggcacctggcgccgccccgttcggaaattttcctcattattctcgcttccaccctccggagcaacggctccgcctcctgcccccggagctgcttcgacagctctttcctgagagtcccgagaacgggccgattctggggctcgacgtggggtgtaactccggggatctgagtgtggctctatacaaacacttcctctccctacctgacggggaaacctgctcagatgcctcaagagaattccgtctcctctgctgcgacatagatccagtcctggtgaagcgagccgaaaaagaatgtccttttcctgatgccttgacttttatcaccctggacttcatgaatcaaaggacccggaaggttctcttgagctctttcttaagccaatttggacgttcagtttttgacattggcttctgcatgtcaataaccatgtggattcatctgaatcatggagaccatggcctatgggagttcctggcccatctttcctccctctgccactacctccttgtggagccccaaccctggaagtgttaccgggcagctgcaaggcgtctccgaaagctgggactccatgattttgaccacttccactcccttgccatccgaggtgacatgcccaatcagattgtgcagatcttgacccaggatcatggcatggaattaatatgttgctttggcaacaccagttgggacagaagccttctgctcttcagggcaaaacaaaccatagagactcatccaatccctgaatcactgatagaaaaagggaaagaaaagaacagattaagtttccagaagcagtgagatgggagggcaagaagaccaagaaagatattgaaagggttttatattgagaattatgttcattctccttaattccttaacaatcaggcagccgcaaaacctggcaggagcttttggtaaaatgtccaaggcacataattgaaagaatcagtatctgttccccattgtttggaacaaatcttgaggagaatgaatctgtggagtgatgagctaggatatctggattgagatggcctaggaaaagtggtcctggttatgggttatggagagggctgcttttggggattatttataaagatcagactaggctagtcttaaaatatgtcagttcctgggctctctgaatcctacctggtttcttcaggcttctggacttgctaggcctgcctttgggcaaaaccttagtaattcaggtctggaatggggcttaggaatctattttctgtttttttgtttgtttgtttttgcattcttctattgtaatatatacataaaatttaccattttaaccgtttttaagtacagtttttcagaacgtggaaatcccatcaaaaattggattaaaaaattaaaagataaat

SEQ ID NO: 694 - DNA, 1589 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttctgttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 695 - DNA, 1413 bp, Homo sapiens
gagagttctgttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtacgtgg

SEQ ID NO: 696 - DNA, 1755 bp, Homo sapiens
agacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaa

SEQ ID NO: 697 - DNA, 611 bp, Homo sapiens
ctcaggcgaagatcaacgctaaagccaacgaggggcgcttctgccgctcctcctccatggctgaccgctccagccgcctgctggagagcctggaccagctggagctcagggagccacataacaagtaacacacatctctccatgtcttcagaacgttgagggcatgttctcaaccacttcattctcctctcccttagccagaaagaaaagttttcctaaaggaatggggaggttgttactccactccgccttccttcaagctgagtcattgtcctccaacttgaattaatgcctcacatgtgggttgaagctttgagagaagcagcaactgctgttgagcaagagaaagaaatccttctggaaatgatccacagtatcctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagt

SEQ ID NO: 698 - DNA, 1252 bp, Homo sapiens
gattcagcggttccgttcgtctctcgggagccacataacaagtaacacacatctctccatgtcttcagaacgttgagggcatgttctcaaccacttcattctcctctcccttagccagaaagaaaagttttcctaaaggaatggggaggttgttactccactccgccttccttcaagctgagtcattgtcctccaacttgaattaatgcctcacatgtgggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatc

SEQ ID NO: 699 - DNA, 2092 bp, Homo sapiens
ggctcctgcccgggcctcattgtgcctcggacaacgagtgtacgcagttaccacacagttaccaagcagttacctcagagccgcggcgcagacgtaggcctcaggtctcgggcctcaggtctcgggcctcagagccagaccccgccatctcacgatgtcagagaggacccaggaacaggattttgttattataactgtcgacgacagtgatgataacaatgattgcagtattgagatggtggaagtttctgaaacagcagataattccactaatgacatagcagatgattccacttatgtcacagcagataatcccactgatgacacagccacacaaccaaattttccaggcggcaatgatggccatcaccgtccactccaaatgtcatatgggtctggctctgtcacccaggctggagtgcagtggcatgatcacagctcactgcagcctcaacctcttggactcaagcaattcttccacctcagccttcccagtagctgggatgacaggcgcacgccaccatgcccagtagcccatggtgaccaaatagtttcacagataaaccacccagtacatttaagaagatacagttacaactcagaggaagtggattttccaaaaagaggaagattctatactccagaggtacagtctagcatatcaccaccagcggaaaggcaggaaacccatgcctgggccagccctgctgtaacatctcttgagtcagcagcatgtcatgaactgcaggaagcagacctcagtgagagtttatcatatcccagaattgtctcctcaagttcattacagcagtatgtcgcacaaggtggctcatttccttgtttcggtatgccatggaactttatcagtggaggtgctgaaagtaccaatgctgtcatctcatttgccaatgctactacagcagtacctatggcagttctgtcacgaagagaatccagtctggcaaataaccctggtgtggtgaattactctgctctaccagaaaatgaaaatgtgggcccaggtagagccttgtcatctttctgcttccatcccaatttggaatctggcccacaaatgagttatgggacaatgagttactcaactgaaatgaaaaataactgtgaccaagatgatgcttcagcatctgcctgcctcactcccgattttgcactgttacctctgaatattttggtaaaagtagacaccaacacggaaaacagcgtcaacacaatgaatcgctcaactttattggacagtgacagtggccaggattcttcctcatcatctgtctgtatccctcccaagtatggctatcttggtgatccaaaaagaaatgtcagagtacttaaaatccatttgctggccgtacaaaatatggccaaacctaagcaagcagcctgctacttggttcgtattttgttctccaaggaaatcctgattagcagctcagtggatatccatttgaaagacagccaatccctcgacccgaacaaaatggctgcattgagagaatatctggcaacaacttttcccacctgtgatttgcatgaacatggaaaagactggcaggactgtatttctggtatcaattctatgatctactgtttatgttctgaaggcaagagtactccaaaaactgttcgcaaaaataaaaaacgtaccaaccgtgttgcatcggcatctgcagatagaaatgaccaaaggggcagagatggtggtgaaggctgttcttggatgtttcagccaatgaataactccaaaatgagagaaaagaggaacttgcagccaaacagtaatgctatccctgaaggaatgcgagaaccttccactgataatccagaggaacctggtgaagcatggagctattttggaagaccatggagaaatatacggatgccatgttcagtactgactttggcaaaaactaagtcttgcgcaagcctgtcggctagataccttattcagaaactcttcacaaaagatgtcctggtccaaagtaacgtctatggcaatctgaagcatggcctgtgtgcccttgaccccaataagattagtgctctccgaggtttgttacacatagagtatgtctga

SEQ ID NO: 700 - DNA, 4611 bp, Homo sapiens
gtgcctcggacaacgagtgtacgcagttaccacacagttaccaagcagttacctcagagccgcggcgcagacgtaggcctcaggtctcgggcctcaggtctcgggcctcagagccagaccccgccatctcacgatgtcagagaggacccaggaacaggattttgttattataactgtcgacgacagtgatgataacaatgattgcagtattgagatggtggaagtttctgaaacagcagataattccactaatgacatagcagatgattccacttatgtcacagcagataatcccactgatgacacagccacacaaccaaattttccaggcggcaatgatggccatcaccgtccactccaaatgtcatatgggtctggctctgtcacccaggctggagtgcagtggcatgatcacagctcactgcagcctcaacctcttggactcaagcaattcttccacctcagccttcccagtagctgggatgacaggcgcacgccaccatgcccagtagcccatggtgaccaaatagtttcacagataaaccacccagtacatttaagaagatacagttacaactcagaggaagtggattttccaaaaagaggaagattctatactccagaggtacagtctagcatatcaccaccagcggaaaggcaggaaacccatgcctgggccagccctgctgtaacatctcttgagtcagcagcatgtcatgaactgcaggaagcagacctcagtgagagtttatcatatcccagaattgtctcctcaagttcattacagcagtatgtcgcacaaggtggctcatttccttgtttcggtatgccatggaactttatcagtggaggtgctgaaagtaccaatgctgtcatctcatttgccaatgctactacagcagtacctatggcagttctgtcacgaagagaatccagtctggcaaataaccctggtgtggtgaattactctgctctaccagaaaatgaaaatgtgggcccaggtagagccttgtcatctttctgcttccatcccaatttggaaatgccagaaagaccagcaaacagcagtaaaaacagcactgagacagcgaattatccaactttaatgggaaattacaatggccaaaatactgcctctttatctgtcttcatccctccctattttgctgagaaaattatacttactgaaatgccaggaacaacagaaaccaacgtggaaaataactctcagacagtgtattacccagctttatcgggaaatacgagtgccccatatccagcctcttcatatcttcccatcacttctaattttgaatctggcccacaaatgagttatgggacaatgagttactcaactgaaatgaaaaataactgtgaccaagatgatgcttcagcatctgcctgcctcactcccgattttgcactgttacctctgaatattttggtaaaagtagacaccaacacggaaaacagcgtcaacacaatgaatcgctcaactttattggacagtgacagtggccaggattcttcctcatcatctgtctgtatccctcccaagtatggctatcttggtgatccaaaaagaaatgtcagagtacttaaaatccatttgctggccgtacaaaatatggccaaacctaagcaagcagcctgctacttggttcgtattttgttctccaaggaaatcctgattagcagctcagtggatatccatttgaaagacagccaatccctcgacccgaacaaaatggctgcattgagagaatatctggcaacaacttttcccacctgtgatttgcatgaacatggaaaagactggcaggactgtatttctggtatcaattctatgatctactgtttatgttctgaaggcaagagtactccaaaaactgttcgcaaaaataaaaaacgtaccaaccgtgttgcatcggcatctgcagatagaaatgaccaaaggggcagagatggtggtgaaggctgttcttggatgtttcagccaatgaataactccaaaatgagagaaaagaggaacttgcagccaaacagtaatgctatccctgaaggaatgcgagaaccttccactgataatccagaggaacctggtgaagcatggagctattttggaagaccatggagaaatatacggatgccatgttcagtactgactttggcaaaaactaagtcttgcgcaagcctgtcggctagataccttattcagaaactcttcacaaaagatgtcctggtccaaagtaacgtctatggcaatctgaagcatggcctgtgtgcccttgaccccaataagattagtgctctccgagagttcctccaagaaaactacccaatttgtgatctctcggaaaatggaagagactggaagtcgtgtgtgacctccatcaacagcggtatccgtagccttagacatgacgtcagaagggctgaagccaggtctcagtcgcttccagcagtgacccctccagagctggagcaggagtcaaagccaggagatcccgacgccactgacccaagcacctgaacggcagctgccaaactttttttttttttttaactgttaagactattttgtaagtttctcaagttctaattccaaaatcagcctgctgtactggcagagtagtttgcattgacacctgtagtaatcgccaaacctctttttctgctcataaaggaggtagaatcacattaggaagatacgtaatgtttcatctgtggatttgatgacaacctctgattgagggaatggtagtaaactcctcatgggcttgtgacccatggctttgacttagataattgacattaatatactttgtttttttgataaggtagagaaagaaattcaatagaaagtaaggagccactcagtcaaataatataattcgtataaaacttgacaagtctttttatttttgtgacttgtgagatagtttaagatatttttatgtgaccaatttgtagaatgaatacatattttcaaagttatcttttcaaaattcaacttttagagtattttagcaaaatatatgtatagtttataatatagaagtatagctttataaagatattaaggatttattttttaaaataattctctgaatagtttgctgtagtagttgccttcagcttaataaaaccatagtacttctacatacatctttataagttaggctatgcctacaaaggtcttaaaaagtagataatttaccgggtgtagtggctcacacctgtaatcccagcactttgggaggccgagacgggtggatcacctgaggtcaggggttcgagaccagcctggccaacatgacgaaaccccatctctactaaaaatacaaaaaaagtagccaggcatggtggcaagcacctgtagtcccagttactcgggtggctgaggcaggagaatcacttgaacctgggaggtggagactgcagtgagccgagattgtgccactgcactcgagcctgggtgacagagtgagactccgtctcgggaaaagaaaaaaaagaagtagataattaaaaaaatcttgcataaaaaaaaatcttccataaagggcaaaaaggctttaacttccattattcagatttaatccaactaagatagtctttggcttcattcactgttcagtttcacaagttttttacaactactagtaacagagctaatacagaatagtaatccacattataaacatagatcaaaataccacatcataccccataaatacatgcagttattatttgtcaattaaaaataaaatttttttaaaagaaaagtacagttcgaccctaggcaagaagaaatttcaaattgtatatgcatattttgaatttggtttatattttgtggtatctgaaatattccctggactagaagcaaaaccacagaaacaaaactttacatttagaaaaaaatttcaagacttctattgctaactttattacattagtggtttttagaagttatttagagcagtcttgtctgatagaactttccaccatgatggaaatgtaaataaatataccacattaaaaatataaatttgcaatgtccaataggctcgtatggctattgagcatttaagatgtaattaattagacagaggaagtaaatttaacattttctctcattttagctaattagaatttaaagtgaaatagccacaagtggatagtggctactgtgttggatggcacagttcaaaatgcctcttatttataaaaaaaagtgtttaaaagtggttcccatggcttgaagaggaataatatacacataacttctttaaaatcacattttgtttgagatggagatcttgctatattgcccaggcttatctggaactcctgggctcaagagggaggatcacatttgactggacaaaatacattttataaaggtgttttgtattttatgttaaagtggaattgtgtcttcaaaattgtgtcttcaaaatttcacaagttaatactattactgtattagtccaatgttaaacattttaaatgcctgctcataagactcatttttgataaataaatgtatctttaatgttttgtttcccaaatagatacaataaataaacatttaaaatgccttaa

SEQ ID NO: 701 - DNA, 6200 bp, Homo sapiens
acacaaagagaggggaaaatacacggcgctcgcccgcccgccgcccccagcgcctccccgggccgccctggccaggccctccgcgcgcggcccccactccccggccccgcgccctcccccccacgtggcgcccaaactcggcgcgggcccgcccggcaaagtacagaactcgcgtcccagcggaatagaagatgaactcaactgaattcaccgaagatgtagaagaagttctaaaaagtatcactgtgaaagtggagacagaggctgaagatgctgctctggactgctccgtgaattccaggacttctgagaagcactctgtggacagcgtcctcactgccctgcaggactccagcaaacgaaagcagctggtcagcgatggcctgctagactctgtccccggcgtgaagaggaggcggctgatccccgaggctctcctagcaggcatgcggaaccgtgagaacagctcgccctgccaaggcaatggtgagcaggccggcaggggcaggagcctgggcaatgtgtggcctggagaggaggagccctgcaacgatgccaccaccccttcctacaagaagcctctgtatggcatctcgcacaagatcatggagaagaagaatcctccctcgggggacctgctaaacgtgtacgagctctttgagaaggcaaacgccagcaacagcccctcgtcactgcggctcctgaatgagccacagaagcgggactgtggcagcaccggggcaggcactgacaacgaccccaacatctacttcctgatccagaagatgttctacatgctgaacaccctcacgtccaacatgtcccagctgcacagcaaggtggacctgctctcccttgaggtgagccgcatcaagaagcaggtgagccccactgagatggtggccaaattccagccgccccctgagtaccagctcacagccgcagagctcaagcagatcgtggaccagagcctgtcagggggggacctggcctgccgcttgctggtgcagctcttccccgagctcttcagcgacgtggacttctcccggggctgcagtgcctgtggctttgcggccaagcgcaagctggagtcgctgcacctgcagctcatccgcaactatgtggaggtctactacccctcggtgaaggacacggctgtgtggcaggccgagtgcctgccccagctgaacgacttcttcagccgcttctgggcccagcgggaaatggaggacagccagcccagcggccaggtcgccagcttctttgaggcagagcaggtggaccccggccacttcctggacaacaaagaccaggaggaggccctgtctcttgaccggagcagcaccatcgcctcagaccacgtggtggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtgtgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatagaaaaa

SEQ ID NO: 702 - DNA, 6644 bp, Homo sapiens
atgggccccgccgccagggggcgcagcgctcccttcccggccgttccacggcggttcgcggttcccgctgcccaggagctggaggcgggcccggcgccttgggtgtgcacccgggctggcgcgaggcctggccggccggccgcaaagctgaagcctggggcgctcgccgctcctcgtgagcgctcctttccttctctatgataaacgtgatttcccacgcatgctttgcccttgcctcatccgtgagctgtgcaccaccgatttggaggcccttgtgtgcttgtttacctacgtctccctatgtagctattttaaacaaggtgtttttacagagataaaagttttattgattgctcaggtggtctttctggaagaattctgcacgtaaacgctaactcgacaagagtgccgggaggaacaaggttactcactagagttggaaatgtgcagttcatctccttaaagtaacttttgaatggttgaatacaaatagtaaacatgccacagggcagcgtggcatagtgccagaaagctacggttgcaggaaactgaggtttaatttttagaagtcaatgtcacctgtagcagagaagttccttgaaatcaaatcagacatatggcaattgtgaaaagattgaacggaatagaagatgaactcaactgaattcaccgaagatgtagaagaagttctaaaaagtatcactgtgaaagtggagacagaggctgaagatgctgctctggactgctccgtgaattccaggacttctgagaagcactctgtggacagcgtcctcactgccctgcaggactccagcaaacgaaagcagctggtcagcgatggcctgctagactctgtccccggcgtgaagaggaggcggctgatccccgaggctctcctagcaggcatgcggaaccgtgagaacagctcgccctgccaaggcaatggtgagcaggccggcaggggcaggagcctgggcaatgtgtggcctggagaggaggagccctgcaacgatgccaccaccccttcctacaagaagcctctgtatggcatctcgcacaagatcatggagaagaagaatcctccctcgggggacctgctaaacgtgtacgagctctttgagaaggcaaacgccagcaacagcccctcgtcactgcggctcctgaatgagccacagaagcgggactgtggcagcaccggggcaggcactgacaacgaccccaacatctacttcctgatccagaagatgttctacatgctgaacaccctcacgtccaacatgtcccagctgcacagcaaggtggacctgctctcccttgaggtgagccgcatcaagaagcaggtgagccccactgagatggtggccaaattccagccgccccctgagtaccagctcacagccgcagagctcaagcagatcgtggaccagagcctgtcagggggggacctggcctgccgcttgctggtgcagctcttccccgagctcttcagcgacgtggacttctcccggggctgcagtgcctgtggctttgcggccaagcgcaagctggagtcgctgcacctgcagctcatccgcaactatgtggaggtctactacccctcggtgaaggacacggctgtgtggcaggccgagtgcctgccccagctgaacgacttcttcagccgcttctgggcccagcgggaaatggaggacagccagcccagcggccaggtcgccagcttctttgaggcagagcaggtggaccccggccacttcctggacaacaaagaccaggaggaggccctgtctcttgaccggagcagcaccatcgcctcagaccacgtggtggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtgtgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgtt

SEQ ID NO: 703 - DNA, 7883 bp, Homo sapiens
atgcagccggcagaggaggggcccagcgtccccaaaatctacaagcagcgcagcccctacagcgtcctcaagacgttccccagtttgaatgttgtttcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccagtgccctgccagaccgttttagattacttgaagatggttctgcagcaccacaaccaactcctgataccacagccagctgaccagccgacagagggaagcaagcagctgttgaacaactatcctgtctacataacgagcaaacagtgggatgaggctgtaaattcttcaaagaaagatgggagacggctccttcgatacctcatcagatttgttttcacaaccgatgagcttaagtactcatgcggccttgggaaaaggaaaaggtcagtgcagtcaggagagacaggtcccgaaagacgccctctggatccagttaaagtaacatgcctccgagaattcattaggatgcattgtacctccaaccccgattggtggatgccctcggaagagcagataaacaaagtgttcagcgacgctgtcggtcacgcccgacaggggcgggcggtggggactttcctgcacaacggtggctcattttatgaagggatcgatcaccaggcttctcaggatgaagtcttcaataaaagttcccaggatggatctggggattagtggacagaatcttcctgttgtagcagctggtcctctcaagagttccaattgtgaatgtcctgttcctgtcacctgagagtccaaagcctgtcattctgccatagtctacacattctcagctgccacagtacccaaatagaaatccattttagggttgtttgggaagtctgtggcacctacaacagacttttggaatattatattataaaaagaaaaaactacatctgatttttaaatgattactagctagatcatgagggtgaaaaaataggtgagctcctagttacctttctgaaatcttcaaactctgctacctgggcagagatagtccccaaggtaggctggggtagtgtttctgcccatgggagaaggtggagacatggagttgtgttaagggacaagaagcaaacattctcttaattcaaataagttgtctttatgttttccaaagacttgacttcatatttctcggcaaagacataggatagatgacatcatataccattttgacattaataatgtctattactaaaaggaaaccagagaacagaggcaacatctgcagacagtgattaattacaggtcaactgtttttctgttgtttaaaaaccactgtgttgatcaagaaggcactatttgatctctggagtttacaaacagtagtcatttttcattgttagtcaagaaacatccaaagatccaaaaccattttcaaatgctcagttttgtaggttaataaatccgcagtttccatagccttaaatcaggctttgttgacacaatgccaaagtgatgggtagaacaatgaaaatttaaagcaattagttgtttggtgcactgaagaccaaacaagtggtgtgactgatggtattcgctgaattgactagatgttctggcattgtatacacacagcttcaaggcgattctgacaactatgcaatgggcttgtcagtaattgctctgaaatttgagggtctttctctgctgagctgatctttagaatttgtatgaaacttgtttcccattgtccttgatgaaaacatttcatcccctccgtgcctcctttaccccaatgtaccccttagctatggctaagtcagcactgtgccgctatcccctggttaatttgttgagttccatatgtgaaattagtggtatctttggaaactttccatattggcaaatgctatagaggtgctagagtcatcatttctgagggcttcctgtttggactcaggagaggctttctttaccaaactagtccagattactacattctttgtagagcaaagggctaaatggacagcgtttattgaaggctactaatgtcatctacagacatgaccaagggtttttgaaaattggttggagattcaggttaatgagcatccattgataaagggtttttgggctatttttgtcaacataaactcataaattgtcctttagatttaatatttagtttgtattcactatatacaaagtcctagaaacaggtctttctgtagcttttgtttattagcttttttgtattactagaattcatccattgaaaagtttaatgtttatggaggtggtcatctgtcagatctgctcaatgatgtagtgggcactaatatttcaatcctgttttgagaaaattaactaaaatttgtcatatcattcaatggaatagggagaaccaatattcaattctatttggggcaaattagctaaaatttggaagtaaaagaaatgatatgggcaaatgccatgttcttacggcagccatgagaccagtctctttggctctccaaggaagaaagatacctcttaaagcattttttagaggtccgagaagtcagtgtctgtcttataagattctttgacaacatgacatcttcgctagaagaaaaacaccaccatagcctcatctgtttttccatcttaccttaatttttcattggccttaagttgtccttactgctgaatacatcgttctgtttttctaaagcaacaatatttgatcactgcttttaagaaaaacagactagcccttcttgtttttctggaagtttgagagtcctgaatatttcttcatatccaaatatcatcttggagccctatcgtgctggtcttcgctgaggctgatgagagcactttctgcacccctgctccatggccgtacatgacaacgcacctgcaccactgctgcaagggcggggggcagcagcctgtgttttggctgtcactgttacctcctgagaaggctgctgtcccaggtttgcacaccacttttgttccaaagttacacatggtctcttcctccctcgcacccattccaggttaatcatttctctatcagctgtttctccatccacagattctgaatgttgagactaattgttgggcatctcttttgcacaaggctgacagactccatactcagcatcgcacagccagttctaactcctctgctgggtctcggacctacagcttttgcctgagtgaaatgttcctacgacttttgctcctgagtgagatattccattgtacttctactgtttgtgtatctgctgggttcctttagccaagcctagcgtctgacgcaggcactagccgccactgaggccgtgatacagcatcactgtggacactgctggctcctctccttgggacatatccacactgccccttgagcttcacctttaaggctggtatgtacgtaagttcacggtggtcgtctgcatggtctcctcttgtttaaatcaggaccaacaaaggatgttcatttgtattttggcaaggcccattgggcctctgtgtagccaggttaaaagctcactcactaggatcggatgctgtcattgctctgtgagcctttcagttgaaatccttggagacttgaaggtgttgcttattattttgatttgattttctgcatctttatctggcaaatggacagattgctctcacaagaaacttagtcatgtcagcttttagagtccttcttgagtcatgttagcattggtagtgtaaaatagattgagttaaaacagctcaggatgcagctgtgcccccacttaattggtgagaggaggaggtcacggggctggcttgacaacaaagactaaatgtggcttttttgtcggtgactaggtgtggtccataagcagaagagccatacctacaaaaagtgacaactgtcctgtgttttccaaattaaaatcttgttacaaagatcatgccggcttttcgcagtgagttgaagccccaagctcagttccagccaggctcaggatgaccctcaaatgatatgtattggatagtgtaggtcaggagcctgtggaggggaccagtattttgcaagcagttactaaagtcacatttctcactgactcttgacggtgcattgttcaaaatctcatggcttaaccttagtgttaaatgctttcaagaaaaactgtaaccatttcaattttacaagtactttctcattttacttgaacattttacaagtactttctgtatttacttgtaaatatttcctctagcccttgaacccgcgcatcacttttttggttttcctcattccaccacagcatttaggtgaccgttaccatttatgtttcattaagcttcactaggaatgtaaggataatattagagcatttgcagaaaattgttatctccttttgtaggggattcgagacatatttgtagctacttcacggctgtagagttagtgggtgatcgggtattctgcattgttccttatccctttgtcagtgacagacacattgacataagagattcctacaggattataaggagagataaattattaaccatttttttacttgatccaactactccatgtcccatcaactagtggtaactgatgttgataggattttttttaagtccagtaactattcttgcagtatcagatgtttaccccaaattaggcaataacccagacttcgaatctgtaggtttatgattcctacattcccctgccgctctcaatggcttgttgcctcccttctgttgctctcagaaaacagatggagatcaggtaaagatgaaacgtgcactatatgttcagaaaagcaaacatccattgtcctcatttagattccatccttcaatttatgctctagaacctaaacctaatacccattgactacctcctgagtttcttaggtttcaattatttttttgaaatgtcatccatggataatagcttcaattttaggaaagatttaaatgtataactttcctcattcagtgctgtgtcatttcacagtacagatctgcgttaatttttgacagctcatatatacagatttttagaaatgtaatagaaaatgattttgcacatatggtgcaagtcttgctggtgtatgtttaatgtggcaacacgtgccagaactgtttggcaaaacatgtcaaatggagtgcttgagtcagaactctaatgtaaatgtgtctaaacagcagtatgtatcattatgatgtatttttgtaaacatagtgatggctgctttcagtcatgtaagtgctggataaaaataaccacttcagttggagtaatgtaggaaaacgtcacccagcagatgggtagtcctctgcaaagttacactgtcagccagtggcactggttcttttatttatgttgggtttttgttttttttttagaggagagtgaagaattgacatcagacaacatggagtgcaaaaataataacccatcaatatttgccttctaaatgtaaaatgtaaaagtttaactgatctgtgtacacattagagaccactttcacacgccacaatatgttcagttgcaggttaacactgagaggttgagacttccctcatctgatgaccagcttggttaatttgacttctgaaggcactaaattaccaagtatttgcagtaatggggaccggattaattttcctcacaattctctatagctgtctgatataagggctgtgtttttattgaatcacagatcctcaaattacagtgaaagcatgtcttgctagtaagactcatttgaaaacctctttattcttggaataattgggccagtacaagtggccagatgtatcctggccacattggaaaactatttgggcccgttcagaaccacttaactgcaacaacagtagtaactatagttaatatctatctattgagttattgtgtgacagttacttggataagtactttaatgcattctcattttaatcctcacagctaccctatgaggctgttactgttcttatccccattgtattgataaggaaactgcccagggtactcagctaagaagaggattgctttgggcataggaagcagaatgacgagttcagtcttcctcagtagttggagcacagttctcaaagcccatcaacactttggaatggatttgttgttttatttatgccatcaagggagagttgatatttgtgtattgctaaaaactactaaagtatgtcgatgcttaggtaggaacatacaaaccatatatcctctgggatctgcccaggtttctgtataaggcttgacctacgtaagatcctatgatgaagaccagaaaactttttttaaaagtaggtaaattaaaattaaaatcacgagtttgttcacatttgtcccataggttcctagtgcaaaaatgcagggagataaaagcaaacatttgaactcagtgaagtgagagtctttgggaactcctagatgttagaaatagcaccggggcatcaggtagccaacgttcaattcacttttcacgtttgtgtctttgtagctttagagctgatgagtctgattggtttggaagagagagttttaatttatgatgtcactgtgagaactgttgtgaaaattttgtaagaaaatacagtaatctgttgattttttcctgtagttttggctttcacatccctttggctgtgtttaagttcaagagcatgccaaggccatgagggtcctggcttgcacttcttgggaacagggcatgctagaggtgggtcatgaagctttcaaggtcactgttccagcccgaccctgcgcaatttaggcattgcctttatgtctctcctctctggaacttcatgtagcagcctaacaccggggccgagttgcctttactctattttctatgatgaatacttgtggagaaactgtgacaaatccattgatcctgatatttttattgttggagtcttgttgattctctatgaataatttctatttgattgtactgtgtagagttaatacccactagggatatgttaataaagctacaaatgcatagtgtaatatagaatagcaagatttttttgtgaacaatttatatagaagagtaagttgttttttaagtgttaggctcatttcttttagaaacttaaaatgttataaaagttttttaaacattcaatatttttaattataagagacatttgttactagagccaattatttcaggtgttctaattggagtgttgattttattacctcatatacctctagaatgccacgtgttctgttggggataaaattgcacaataaatgtcaagtctctgttaagtgttttaacttggtttttgcatctttctaattcattgtaaatacttttctgtttctttgaatacataacttttctctccctgaa

SEQ ID NO: 704 - DNA, 8765 bp, Homo sapiens
gcgatgctcggggaaagcaggaccccaaagccccgtaaacaccgcgcgaccacccgggccaagatcttcaagaggttcttttcagaaggatcggagagcaattcccgattggtagaagaacttgctgtaatacacacgtactctgacgaccccgccccaacgactagcccctcctctgtgcaaccccgagagtttggggtcatgcagggggcgccacgagctcgtttcggaagccggaccccgcccgcagccgcagaagcctcgagtccacatctgggtctctaaagtctcgccgtagccagatcccggatccccaccttcttcaccagttcccgggcgtcctccaggcattggcgaggcagcctgtcaatcaggagctcgggcggcagccccccgcgcgggggctcggcgatgccagcctcagcgacaggcggcggcggcggcggccacggcacagacacacaccctcccacacgcgcgcaccagggcagacccggcgggcaggcggcggaggcaccctcggagcccggcgcccggcggggaggggacgtgctccgagggaccggccccgaggcgccggatggaggaagagatgcagccggcagaggaggggcccagcgtccccaaaatctacaagcagcgcagcccctacagcgtcctcaagacgttccccagcaagagaccggcgctggccaagcgctacgagcgacccaccctggtggagctgccgcacgtgcgggcgcccccgccgcccccgccgcccttcgcgccgcacgccgccgtctccatcagcagcagcgagccgccgccgcagcagttccaggcgcagagctcctacccccccgggcccggccgggccgccgccgccgcttcgtcgtcgtcgccgtcctgcacgcccgccacatcccagggccacttgaggactccggcgcagccgccgcccgcgtcccccgccgcctcctcgtcgtcttcgttcgccgctgtcgtcaggtatggcccaggcgcggcggcggccgccggcaccggcggcacgggtagcgacagcgccagcctggagctcagcgcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccagtgccctgccagaccgttttagattacttgaagatggttctgcagcaccacaaccaactcctgataccacagccagctgaccagccgacagagggaagcaagcagctgttgaacaactatcctgtctacataacgagcaaacagtgggatgaggctgtaaattcttcaaagaaagatgggagacggctccttcgatacctcatcagatttgttttcacaaccgatgagcttaagtactcatgcggccttgggaaaaggaaaaggtcagtgcagtcaggagagacaggtcccgaaagacgccctctggatccagttaaagtaacatgcctccgagaattcattaggatgcattgtacctccaaccccgattggtggatgccctcggaagagcagataaacaaagtgttcagcgacgctgtcggtcacgcccgacaggggcgggcggtggggactttcctgcacaacggtggctcattttatgaagggatcgatcaccaggcttctcaggatgaagtcttcaataaaagttcccaggatggatctggggattagtggacagaatcttcctgttgtagcagctggtcctctcaagagttccaattgtgaatgtcctgttcctgtcacctgagagtccaaagcctgtcattctgccatagtctacacattctcagctgccacagtacccaaatagaaatccattttagggttgtttgggaagtctgtggcacctacaacagacttttggaatattatattataaaaagaaaaaactacatctgatttttaaatgattactagctagatcatgagggtgaaaaaataggtgagctcctagttacctttctgaaatcttcaaactctgctacctgggcagagatagtccccaaggtaggctggggtagtgtttctgcccatgggagaaggtggagacatggagttgtgttaagggacaagaagcaaacattctcttaattcaaataagttgtctttatgttttccaaagacttgacttcatatttctcggcaaagacataggatagatgacatcatataccattttgacattaataatgtctattactaaaaggaaaccagagaacagaggcaacatctgcagacagtgattaattacaggtcaactgtttttctgttgtttaaaaaccactgtgttgatcaagaaggcactatttgatctctggagtttacaaacagtagtcatttttcattgttagtcaagaaacatccaaagatccaaaaccattttcaaatgctcagttttgtaggttaataaatccgcagtttccatagccttaaatcaggctttgttgacacaatgccaaagtgatgggtagaacaatgaaaatttaaagcaattagttgtttggtgcactgaagaccaaacaagtggtgtgactgatggtattcgctgaattgactagatgttctggcattgtatacacacagcttcaaggcgattctgacaactatgcaatgggcttgtcagtaattgctctgaaatttgagggtctttctctgctgagctgatctttagaatttgtatgaaacttgtttcccattgtccttgatgaaaacatttcatcccctccgtgcctcctttaccccaatgtaccccttagctatggctaagtcagcactgtgccgctatcccctggttaatttgttgagttccatatgtgaaattagtggtatctttggaaactttccatattggcaaatgctatagaggtgctagagtcatcatttctgagggcttcctgtttggactcaggagaggctttctttaccaaactagtccagattactacattctttgtagagcaaagggctaaatggacagcgtttattgaaggctactaatgtcatctacagacatgaccaagggtttttgaaaattggttggagattcaggttaatgagcatccattgataaagggtttttgggctatttttgtcaacataaactcataaattgtcctttagatttaatatttagtttgtattcactatatacaaagtcctagaaacaggtctttctgtagcttttgtttattagcttttttgtattactagaattcatccattgaaaagtttaatgtttatggaggtggtcatctgtcagatctgctcaatgatgtagtgggcactaatatttcaatcctgttttgagaaaattaactaaaatttgtcatatcattcaatggaatagggagaaccaatattcaattctatttggggcaaattagctaaaatttggaagtaaaagaaatgatatgggcaaatgccatgttcttacggcagccatgagaccagtctctttggctctccaaggaagaaagatacctcttaaagcattttttagaggtccgagaagtcagtgtctgtcttataagattctttgacaacatgacatcttcgctagaagaaaaacaccaccatagcctcatctgtttttccatcttaccttaatttttcattggccttaagttgtccttactgctgaatacatcgttctgtttttctaaagcaacaatatttgatcactgcttttaagaaaaacagactagcccttcttgtttttctggaagtttgagagtcctgaatatttcttcatatccaaatatcatcttggagccctatcgtgctggtcttcgctgaggctgatgagagcactttctgcacccctgctccatggccgtacatgacaacgcacctgcaccactgctgcaagggcggggggcagcagcctgtgttttggctgtcactgttacctcctgagaaggctgctgtcccaggtttgcacaccacttttgttccaaagttacacatggtctcttcctccctcgcacccattccaggttaatcatttctctatcagctgtttctccatccacagattctgaatgttgagactaattgttgggcatctcttttgcacaaggctgacagactccatactcagcatcgcacagccagttctaactcctctgctgggtctcggacctacagcttttgcctgagtgaaatgttcctacgacttttgctcctgagtgagatattccattgtacttctactgtttgtgtatctgctgggttcctttagccaagcctagcgtctgacgcaggcactagccgccactgaggccgtgatacagcatcactgtggacactgctggctcctctccttgggacatatccacactgccccttgagcttcacctttaaggctggtatgtacgtaagttcacggtggtcgtctgcatggtctcctcttgtttaaatcaggaccaacaaaggatgttcatttgtattttggcaaggcccattgggcctctgtgtagccaggttaaaagctcactcactaggatcggatgctgtcattgctctgtgagcctttcagttgaaatccttggagacttgaaggtgttgcttattattttgatttgattttctgcatctttatctggcaaatggacagattgctctcacaagaaacttagtcatgtcagcttttagagtccttcttgagtcatgttagcattggtagtgtaaaatagattgagttaaaacagctcaggatgcagctgtgcccccacttaattggtgagaggaggaggtcacggggctggcttgacaacaaagactaaatgtggcttttttgtcggtgactaggtgtggtccataagcagaagagccatacctacaaaaagtgacaactgtcctgtgttttccaaattaaaatcttgttacaaagatcatgccggcttttcgcagtgagttgaagccccaagctcagttccagccaggctcaggatgaccctcaaatgatatgtattggatagtgtaggtcaggagcctgtggaggggaccagtattttgcaagcagttactaaagtcacatttctcactgactcttgacggtgcattgttcaaaatctcatggcttaaccttagtgttaaatgctttcaagaaaaactgtaaccatttcaattttacaagtactttctcattttacttgaacattttacaagtactttctgtatttacttgtaaatatttcctctagcccttgaacccgcgcatcacttttttggttttcctcattccaccacagcatttaggtgaccgttaccatttatgtttcattaagcttcactaggaatgtaaggataatattagagcatttgcagaaaattgttatctccttttgtaggggattcgagacatatttgtagctacttcacggctgtagagttagtgggtgatcgggtattctgcattgttccttatccctttgtcagtgacagacacattgacataagagattcctacaggattataaggagagataaattattaaccatttttttacttgatccaactactccatgtcccatcaactagtggtaactgatgttgataggattttttttaagtccagtaactattcttgcagtatcagatgtttaccccaaattaggcaataacccagacttcgaatctgtaggtttatgattcctacattcccctgccgctctcaatggcttgttgcctcccttctgttgctctcagaaaacagatggagatcaggtaaagatgaaacgtgcactatatgttcagaaaagcaaacatccattgtcctcatttagattccatccttcaatttatgctctagaacctaaacctaatacccattgactacctcctgagtttcttaggtttcaattatttttttgaaatgtcatccatggataatagcttcaattttaggaaagatttaaatgtataactttcctcattcagtgctgtgtcatttcacagtacagatctgcgttaatttttgacagctcatatatacagatttttagaaatgtaatagaaaatgattttgcacatatggtgcaagtcttgctggtgtatgtttaatgtggcaacacgtgccagaactgtttggcaaaacatgtcaaatggagtgcttgagtcagaactctaatgtaaatgtgtctaaacagcagtatgtatcattatgatgtatttttgtaaacatagtgatggctgctttcagtcatgtaagtgctggataaaaataaccacttcagttggagtaatgtaggaaaacgtcacccagcagatgggtagtcctctgcaaagttacactgtcagccagtggcactggttcttttatttatgttgggtttttgttttttttttagaggagagtgaagaattgacatcagacaacatggagtgcaaaaataataacccatcaatatttgccttctaaatgtaaaatgtaaaagtttaactgatctgtgtacacattagagaccactttcacacgccacaatatgttcagttgcaggttaacactgagaggttgagacttccctcatctgatgaccagcttggttaatttgacttctgaaggcactaaattaccaagtatttgcagtaatggggaccggattaattttcctcacaattctctatagctgtctgatataagggctgtgtttttattgaatcacagatcctcaaattacagtgaaagcatgtcttgctagtaagactcatttgaaaacctctttattcttggaataattgggccagtacaagtggccagatgtatcctggccacattggaaaactatttgggcccgttcagaaccacttaactgcaacaacagtagtaactatagttaatatctatctattgagttattgtgtgacagttacttggataagtactttaatgcattctcattttaatcctcacagctaccctatgaggctgttactgttcttatccccattgtattgataaggaaactgcccagggtactcagctaagaagaggattgctttgggcataggaagcagaatgacgagttcagtcttcctcagtagttggagcacagttctcaaagcccatcaacactttggaatggatttgttgttttatttatgccatcaagggagagttgatatttgtgtattgctaaaaactactaaagtatgtcgatgcttaggtaggaacatacaaaccatatatcctctgggatctgcccaggtttctgtataaggcttgacctacgtaagatcctatgatgaagaccagaaaactttttttaaaagtaggtaaattaaaattaaaatcacgagtttgttcacatttgtcccataggttcctagtgcaaaaatgcagggagataaaagcaaacatttgaactcagtgaagtgagagtctttgggaactcctagatgttagaaatagcaccggggcatcaggtagccaacgttcaattcacttttcacgtttgtgtctttgtagctttagagctgatgagtctgattggtttggaagagagagttttaatttatgatgtcactgtgagaactgttgtgaaaattttgtaagaaaatacagtaatctgttgattttttcctgtagttttggctttcacatccctttggctgtgtttaagttcaagagcatgccaaggccatgagggtcctggcttgcacttcttgggaacagggcatgctagaggtgggtcatgaagctttcaaggtcactgttccagcccgaccctgcgcaatttaggcattgcctttatgtctctcctctctggaacttcatgtagcagcctaacaccggggccgagttgcctttactctattttctatgatgaatacttgtggagaaactgtgacaaatccattgatcctgatatttttattgttggagtcttgttgattctctatgaataatttctatttgattgtactgtgtagagttaatacccactagggatatgttaataaagctacaaatgcatagtgtaatatagaatagcaagatttttttgtgaacaatttatatagaagagtaagttgttttttaagtgttaggctcatttcttttagaaacttaaaatgttataaaagttttttaaacattcaatatttttaattataagagacatttgttactagagccaattatttcaggtgttctaattggagtgttgattttattacctcatatacctctagaatgccacgtgttctgttggggataaaattgcacaataaatgtcaagtctctgttaa

SEQ ID NO: 705 - DNA, 8692 bp, Homo sapiens
gcgatgctcggggaaagcaggaccccaaagccccgtaaacaccgcgcgaccacccgggccaagatcttcaagaggttcttttcagaaggatcggagagcaattcccgattggtagaagaacttgctgtaatacacacgtactctgacgaccccgccccaacgactagcccctcctctgtgcaaccccgagagtttggggtcatgcagggggcgccacgagctcgtttcggaagccggaccccgcccgcagccgcagaagcctcgagtccacatctgggtctctaaagtctcgccgtagccagatcccggatccccaccttcttcaccagttcccgggcgtcctccaggcattggcgaggcagcctgtcaatcaggagctcgggcggcagccccccgcgcgggggctcggcgatgccagcctcagcgacaggcggcggcggcggcggccacggcacagacacacaccctcccacacgcgcgcaccagggcagacccggcgggcaggcggcggaggcaccctcggagcccggcgcccggcggggaggggacgtgctccgagggaccggccccgaggcgccggatggaggaagagatgcagccggcagaggaggggcccagcgtccccaaaatctacaagcagcgcagcccctacagcgtcctcaagacgttccccagcaagagaccggcgctggccaagcgctacgagcgacccaccctggtggagctgccgcacgtgcgggcgcccccgccgcccccgccgcccttcgcgccgcacgccgccgtctccatcagcagcagcgagccgccgccgcagcagttccaggcgcagagctcctacccccccgggcccggccgggccgccgccgccgcttcgtcgtcgtcgccgtcctgcacgcccgccacatcccagggccacttgaggactccggcgcagccgccgcccgcgtcccccgccgcctcctcgtcgtcttcgttcgccgctgtcgtcaggtatggcccaggcgcggcggcggccgccggcaccggcggcacgggtagcgacagcgccagcctggagctcagcgcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccagtgccctgccagaccgttttagattacttgaagatggttctgcagcaccacaaccaactcctgataccacagccagctgaccagccgacagagggaagcaagcagctgttgaacaactatcctgtctacataacgagcaaacagtgggatgaggctgtaaattcttcaaagaaagatgggagacggctccttcgatacctcatcagatttgttttcacaaccgatgagcttaagtactcatgcggccttgggaaaaggaaaagaattcattaggatgcattgtacctccaaccccgattggtggatgccctcggaagagcagataaacaaagtgttcagcgacgctgtcggtcacgcccgacaggggcgggcggtggggactttcctgcacaacggtggctcattttatgaagggatcgatcaccaggcttctcaggatgaagtcttcaataaaagttcccaggatggatctggggattagtggacagaatcttcctgttgtagcagctggtcctctcaagagttccaattgtgaatgtcctgttcctgtcacctgagagtccaaagcctgtcattctgccatagtctacacattctcagctgccacagtacccaaatagaaatccattttagggttgtttgggaagtctgtggcacctacaacagacttttggaatattatattataaaaagaaaaaactacatctgatttttaaatgattactagctagatcatgagggtgaaaaaataggtgagctcctagttacctttctgaaatcttcaaactctgctacctgggcagagatagtccccaaggtaggctggggtagtgtttctgcccatgggagaaggtggagacatggagttgtgttaagggacaagaagcaaacattctcttaattcaaataagttgtctttatgttttccaaagacttgacttcatatttctcggcaaagacataggatagatgacatcatataccattttgacattaataatgtctattactaaaaggaaaccagagaacagaggcaacatctgcagacagtgattaattacaggtcaactgtttttctgttgtttaaaaaccactgtgttgatcaagaaggcactatttgatctctggagtttacaaacagtagtcatttttcattgttagtcaagaaacatccaaagatccaaaaccattttcaaatgctcagttttgtaggttaataaatccgcagtttccatagccttaaatcaggctttgttgacacaatgccaaagtgatgggtagaacaatgaaaatttaaagcaattagttgtttggtgcactgaagaccaaacaagtggtgtgactgatggtattcgctgaattgactagatgttctggcattgtatacacacagcttcaaggcgattctgacaactatgcaatgggcttgtcagtaattgctctgaaatttgagggtctttctctgctgagctgatctttagaatttgtatgaaacttgtttcccattgtccttgatgaaaacatttcatcccctccgtgcctcctttaccccaatgtaccccttagctatggctaagtcagcactgtgccgctatcccctggttaatttgttgagttccatatgtgaaattagtggtatctttggaaactttccatattggcaaatgctatagaggtgctagagtcatcatttctgagggcttcctgtttggactcaggagaggctttctttaccaaactagtccagattactacattctttgtagagcaaagggctaaatggacagcgtttattgaaggctactaatgtcatctacagacatgaccaagggtttttgaaaattggttggagattcaggttaatgagcatccattgataaagggtttttgggctatttttgtcaacataaactcataaattgtcctttagatttaatatttagtttgtattcactatatacaaagtcctagaaacaggtctttctgtagcttttgtttattagcttttttgtattactagaattcatccattgaaaagtttaatgtttatggaggtggtcatctgtcagatctgctcaatgatgtagtgggcactaatatttcaatcctgttttgagaaaattaactaaaatttgtcatatcattcaatggaatagggagaaccaatattcaattctatttggggcaaattagctaaaatttggaagtaaaagaaatgatatgggcaaatgccatgttcttacggcagccatgagaccagtctctttggctctccaaggaagaaagatacctcttaaagcattttttagaggtccgagaagtcagtgtctgtcttataagattctttgacaacatgacatcttcgctagaagaaaaacaccaccatagcctcatctgtttttccatcttaccttaatttttcattggccttaagttgtccttactgctgaatacatcgttctgtttttctaaagcaacaatatttgatcactgcttttaagaaaaacagactagcccttcttgtttttctggaagtttgagagtcctgaatatttcttcatatccaaatatcatcttggagccctatcgtgctggtcttcgctgaggctgatgagagcactttctgcacccctgctccatggccgtacatgacaacgcacctgcaccactgctgcaagggcggggggcagcagcctgtgttttggctgtcactgttacctcctgagaaggctgctgtcccaggtttgcacaccacttttgttccaaagttacacatggtctcttcctccctcgcacccattccaggttaatcatttctctatcagctgtttctccatccacagattctgaatgttgagactaattgttgggcatctcttttgcacaaggctgacagactccatactcagcatcgcacagccagttctaactcctctgctgggtctcggacctacagcttttgcctgagtgaaatgttcctacgacttttgctcctgagtgagatattccattgtacttctactgtttgtgtatctgctgggttcctttagccaagcctagcgtctgacgcaggcactagccgccactgaggccgtgatacagcatcactgtggacactgctggctcctctccttgggacatatccacactgccccttgagcttcacctttaaggctggtatgtacgtaagttcacggtggtcgtctgcatggtctcctcttgtttaaatcaggaccaacaaaggatgttcatttgtattttggcaaggcccattgggcctctgtgtagccaggttaaaagctcactcactaggatcggatgctgtcattgctctgtgagcctttcagttgaaatccttggagacttgaaggtgttgcttattattttgatttgattttctgcatctttatctggcaaatggacagattgctctcacaagaaacttagtcatgtcagcttttagagtccttcttgagtcatgttagcattggtagtgtaaaatagattgagttaaaacagctcaggatgcagctgtgcccccacttaattggtgagaggaggaggtcacggggctggcttgacaacaaagactaaatgtggcttttttgtcggtgactaggtgtggtccataagcagaagagccatacctacaaaaagtgacaactgtcctgtgttttccaaattaaaatcttgttacaaagatcatgccggcttttcgcagtgagttgaagccccaagctcagttccagccaggctcaggatgaccctcaaatgatatgtattggatagtgtaggtcaggagcctgtggaggggaccagtattttgcaagcagttactaaagtcacatttctcactgactcttgacggtgcattgttcaaaatctcatggcttaaccttagtgttaaatgctttcaagaaaaactgtaaccatttcaattttacaagtactttctcattttacttgaacattttacaagtactttctgtatttacttgtaaatatttcctctagcccttgaacccgcgcatcacttttttggttttcctcattccaccacagcatttaggtgaccgttaccatttatgtttcattaagcttcactaggaatgtaaggataatattagagcatttgcagaaaattgttatctccttttgtaggggattcgagacatatttgtagctacttcacggctgtagagttagtgggtgatcgggtattctgcattgttccttatccctttgtcagtgacagacacattgacataagagattcctacaggattataaggagagataaattattaaccatttttttacttgatccaactactccatgtcccatcaactagtggtaactgatgttgataggattttttttaagtccagtaactattcttgcagtatcagatgtttaccccaaattaggcaataacccagacttcgaatctgtaggtttatgattcctacattcccctgccgctctcaatggcttgttgcctcccttctgttgctctcagaaaacagatggagatcaggtaaagatgaaacgtgcactatatgttcagaaaagcaaacatccattgtcctcatttagattccatccttcaatttatgctctagaacctaaacctaatacccattgactacctcctgagtttcttaggtttcaattatttttttgaaatgtcatccatggataatagcttcaattttaggaaagatttaaatgtataactttcctcattcagtgctgtgtcatttcacagtacagatctgcgttaatttttgacagctcatatatacagatttttagaaatgtaatagaaaatgattttgcacatatggtgcaagtcttgctggtgtatgtttaatgtggcaacacgtgccagaactgtttggcaaaacatgtcaaatggagtgcttgagtcagaactctaatgtaaatgtgtctaaacagcagtatgtatcattatgatgtatttttgtaaacatagtgatggctgctttcagtcatgtaagtgctggataaaaataaccacttcagttggagtaatgtaggaaaacgtcacccagcagatgggtagtcctctgcaaagttacactgtcagccagtggcactggttcttttatttatgttgggtttttgttttttttttagaggagagtgaagaattgacatcagacaacatggagtgcaaaaataataacccatcaatatttgccttctaaatgtaaaatgtaaaagtttaactgatctgtgtacacattagagaccactttcacacgccacaatatgttcagttgcaggttaacactgagaggttgagacttccctcatctgatgaccagcttggttaatttgacttctgaaggcactaaattaccaagtatttgcagtaatggggaccggattaattttcctcacaattctctatagctgtctgatataagggctgtgtttttattgaatcacagatcctcaaattacagtgaaagcatgtcttgctagtaagactcatttgaaaacctctttattcttggaataattgggccagtacaagtggccagatgtatcctggccacattggaaaactatttgggcccgttcagaaccacttaactgcaacaacagtagtaactatagttaatatctatctattgagttattgtgtgacagttacttggataagtactttaatgcattctcattttaatcctcacagctaccctatgaggctgttactgttcttatccccattgtattgataaggaaactgcccagggtactcagctaagaagaggattgctttgggcataggaagcagaatgacgagttcagtcttcctcagtagttggagcacagttctcaaagcccatcaacactttggaatggatttgttgttttatttatgccatcaagggagagttgatatttgtgtattgctaaaaactactaaagtatgtcgatgcttaggtaggaacatacaaaccatatatcctctgggatctgcccaggtttctgtataaggcttgacctacgtaagatcctatgatgaagaccagaaaactttttttaaaagtaggtaaattaaaattaaaatcacgagtttgttcacatttgtcccataggttcctagtgcaaaaatgcagggagataaaagcaaacatttgaactcagtgaagtgagagtctttgggaactcctagatgttagaaatagcaccggggcatcaggtagccaacgttcaattcacttttcacgtttgtgtctttgtagctttagagctgatgagtctgattggtttggaagagagagttttaatttatgatgtcactgtgagaactgttgtgaaaattttgtaagaaaatacagtaatctgttgattttttcctgtagttttggctttcacatccctttggctgtgtttaagttcaagagcatgccaaggccatgagggtcctggcttgcacttcttgggaacagggcatgctagaggtgggtcatgaagctttcaaggtcactgttccagcccgaccctgcgcaatttaggcattgcctttatgtctctcctctctggaacttcatgtagcagcctaacaccggggccgagttgcctttactctattttctatgatgaatacttgtggagaaactgtgacaaatccattgatcctgatatttttattgttggagtcttgttgattctctatgaataatttctatttgattgtactgtgtagagttaatacccactagggatatgttaataaagctacaaatgcatagtgtaatatagaatagcaagatttttttgtgaacaatttatatagaagagtaagttgttttttaagtgttaggctcatttcttttagaaacttaaaatgttataaaagttttttaaacattcaatatttttaattataagagacatttgttactagagccaattatttcaggtgttctaattggagtgttgattttattacctcatatacctctagaatgccacgtgttctgttggggataaaattgcacaataaatgtcaagtctctgtt

SEQ ID NO: 706 - DNA, 1156 bp, Homo sapiens
gcggccgccgccgacctcagcatcccagaagccgggcgcacgtgggtcggggcggggacgcggcgctcaggctgcagccgcggcagcctgcggggggcgggaatggggcgccgcggcgggggctcggctgatgacatcacggccaggctgcggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccgagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaagtgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcaaaatcctctacttcaagggacaaagctgtaa

SEQ ID NO: 707 - DNA, 579 bp, Homo sapiens
gctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaaggaaacaaactagatataacaacagagaagaccattttacatggaggcatgaaaactttgaatgttgttaccacaagcagtcacccagtttga

SEQ ID NO: 708 - DNA, 2379 bp, Homo sapiens
ctatccagcctccctcggccaaattgctgcggagcccgtcgtcagggggcgccaaggagccagggggaaaaccgagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaagtgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcagattgcccgttgtaacaagagcaagcctcagaagtttattaatgatttaatgcaagtactttacacaaatgaatacatggccactcacagcctgacaggggcaaaatcctctacttcaagggacaaagctgtaaaaccagctatgaatcagaatgaagtccaagaaatcataggagtaacaaaacaattatttcccaatacggatgatgtttcaattaggagaatgatagggcaaaagctaaacaactgtaccaagaagccaaatttaagcaaaaatcttaactctcaggatattaaatagatccttttggtattacaggtatctgaaacaaagcaccttcaattctaaatctagcactggattttgttggagaatctgcagccttcctggcagtgagaaagacagacatgtgcagtgacaggctgtaagacatatgtaacattgctgagctctcctaagggaccaacaagcttgctgaagaagctgcatgtagattccaccctcagtactagtgatgcatcaaaccagagaatttctgccagtcaaataagcatgcaatatggtttctttggaaataagcatttcccaatccccaaatacccctctgtacagttaatctaacaggatagtcagagctcttatcatagcagccaaaacttcagcccataggttagtcattgtcctaaccaatcattgtacattgattattaccagtgacttcccattatagtttttggatctttagcataagcacatgcttgcaaaagtaaacagtgaaataattaatgttggcaaatatgagaacaacaaagtcagcccaaaatctgataatcatgtctaaccaagtaataatgttttagcaataaaattacaggattattctgttatctaaaaatgtataaaatgggaatatgaaaaaaatgacaacagcaagatgttttattttaatgttaagcaattccaccacacttctgaagaataaacctaagtttttgtgattgttaaaacaatgcatcaattttcagggaaatctttttgtttgtttatttaccagacatgttctaactttgtattgcccaaagtatattaaatacagatgtgtaatataaagcatcaatatcacctaacacatcgtatataagatataacatgatagatagttggtcgattacattgctatactgcttagttttaactggtttatttttattgtagcagaaatgaactgaaaaaaaatatgggtttgataatcacacacatgaaagtaccattttgtaactcaacaaaagataaaacattcttcatcaaaaggcttctcgcttggtgtcaggttgtcacatgtgaccactgtgcaatgcgaagccatacttcttcagtgcacaaagtcatgtttaaacttggaaaagaggatgctacagtagtttcaaagttcagtgttgtggacccaggaaattttccataagtcttgcttgataacaatgtgattgtacaaaataaatgttcttaaggaaacaacttatgtaacatttgctacctttatgtaaacataaataaatcccatttaaaagat

SEQ ID NO: 709 - DNA, 3497 bp, Homo sapiens
ggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccgagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaagcttggtccagagagctgccttagactctccaatgaatgtgttcaaacagctgcctctgttaccttgactcatctcagatacgggtcctggtgctaggaatcaaagactgtctctattattttggcttgctccaggttgggcagaagcccatgcaaggctactactgatcatgtttcatttctagctttgatgtctgggcactgatttccctaggtttaactatttgctcaatgtcaaggcagtgctgtggaaatctgtctgtgtaactggagtgctatgcagacctgtctgtgtgactgtcatgcaggcctgtctgtgtgattgtcagggagaattggcctgccacaacttcactgcagcctgggtgacagacacagacaccatctcttaaaaaaagaaaaaagaaaaaaaaataggcaaatgatctgaacagatatttctcagtaagacatacaaatggccaacaggtatatgaaaaaaatgctcaacatcactgatcaccagggaaatgcgtatcaaaaccacagtgaggtaacatctcaccccaggaagtatggctattatcaaaaagacaaaaacaaaacaaattctagtgaagatgtggagaaaagcgaactctaatacactgtgggtatgaatgtaaaccagtgcagccactatggagacagcatcgttcacaatagataacatagggaatcaacttaagtgtccaacaacagatgaatagataaagaaaatgtggcatatatacacaatggaatattattcatccataaaacagaatgaaatcctgtcatttttggcaacagggatgatcattatgttaagtgaaataagcgaggaatagaaagttaaacactgcatgttctcatttgtatacggaagctaaaaagaaaaaggttaatctcatagaagtaaaaagtagaacagaggatacaagaggctggaaagggcagggggaagggaaaggtagggagagatttattaaaggatacaaaattacagctagatgggaagaataagttctaatgttcaatacccctgtgggattactatagttaacaatagtatatattttcaagtagctagaaggaggattttgaatgttcccaacataaaaaaatgataaatgtttgcagtaatagatatgctaattaccctgatctgacctttatacattatatgtatcaaaacatcattatttgccctatgaaaatgtataattaaaatattaaataaaatcaaattttaaaaaaggattttctaatatggttccctgagtagtcctagaaacaggaactcaatagccaagagcactcctagcaattagatgtgcccttgtaatatcattaaccattaaagggaacgatgactccttggataaatggctgattccatgtcttgcatacaaaatatacaaaatgagacttgtgaagaagcttgagcaggaaatatacaggaacatcttgtcatatcagaaagcaaggaagttagaccatgcagatgtgtcaactagaagagcttcccacaagccaaagatgggacagtttgagcatgaataagaatgacaaccacaatagatagacacatattgtattgatatatgtttaatgcatgagttcacagtggtattcaaaaaagaagaaaacgttatggtcatctgaaaacaaccaactcataattttgaaaattggcagatacaaaccaaaatcaagcgtgtatcctgccattactatatgaaatgaacttctgggtaaccaaacagttgataagaggaactttccctttgtagaactccagctaataaatgaagaaaataattagaatatcactattttgcaagccattgtgacataatgaatctatgcagtgaccatctgtagctggtaagatcacaaaaaagctaaccaggcattaaataccacctgatggaagttaaaacagtacctgaatccgatcaacccttcagatctaactaccaatctacatcaaatacagggaacaggagaatatgtcaaataccacctaaaggtgcaatcacagcaaaatccgactgtaggaaattctccaggacaaatgacccagtttctacaattaataaattgcaagggaaaaaactaggaagggagaggaaacctatagtttatatggaagagacagcaaccagttgtaatgtatagtccttactggatcttgattcgaacaaacttaaaaaataagaccatcagagaaatttgaacattgactaaggtttttttaaacgatattaaaaaactattgttaactatttctggctgcagtagtggtgttaacagttataattttaaatacaccttttagagatgcctacagaaatatttacagataaaaatgagatgatgcctgtgctttgcatcaaataatttgggggataaaggggatcagggtataagtggattgagacttgccatgaattgaaatgggagaatttgctatttttgtttctgtttaaaattttccattaaaagtttaaaaaatatatccaggaaaacagcctacttatgaaaagatatttaaattctacaaaattgttggtgaatatttaactgatctgagtgatgaatgagtaagtataaaataaatggataatatactaagaaaagactgctactttcaactaaaatgaaaatttaaattatgtgtgtttaaaatgttataaaattaaaagataaacactttgagaaaaatatttgcaactcaagaaaaataaaagattaaaatgctt

SEQ ID NO: 710 - DNA, 2758 bp, Homo sapiens
gcggccgccgccgacctcagcatcccagaagccgggcgcacgtgggtcggggcggggacgcggcgctcaggctgcagccgcggcagcctgcggggggcgggaatggggcgccgcggcgggggctcggctgatgacatcacggccaggctgcggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccgagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaaggaaacaaactagatataacaacagagaagaccattttacatggaggcatgaaaactttgaatgttgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcagattgcccgttgtaacaagagcaagcctcagaagtttattaatgatttaatgcaagtactttacacaaatgaatacatggccactcacagcctgacaggggcaaaatcctctacttcaagggacaaagctgtaaaaccagctatgaatcagaatgaagtccaagaaatcataggagtaacaaaacaattatttcccaatacggatgatgtttcaattaggagaatgatagggcaaaagctaaacaactgtaccaagaagccaaatttaagcaaaaatcttaactctcaggatattaaatagatccttttggtattacaggtatctgaaacaaagcaccttcaattctaaatctagcactggattttgttggagaatctgcagccttcctggcagtgagaaagacagacatgtgcagtgacaggctgtaagacatatgtaacattgctgagctctcctaagggaccaacaagcttgctgaagaagctgcatgtagattccaccctcagtactagtgatgcatcaaaccagagaatttctgccagtcaaataagcatgcaatatggtttctttggaaataagcatttcccaatccccaaatacccctctgtacagttaatctaacaggatagtcagagctcttatcatagcagccaaaacttcagcccataggttagtcattgtcctaaccaatcattgtacattgattattaccagtgacttcccattatagtttttggatctttagcataagcacatgcttgcaaaagtaaacagtgaaataattaatgttggcaaatatgagaacaacaaagtcagcccaaaatctgataatcatgtctaaccaagtaataatgttttagcaataaaattacaggattattctgttatctaaaaatgtataaaatgggaatatgaaaaaaatgacaacagcaagatgttttattttaatgttaagcaattccaccacacttctgaagaataaacctaagtttttgtgattgttaaaacaatgcatcaattttcagggaaatctttttgtttgtttatttaccagacatgttctaactttgtattgcccaaagtatattaaatacagatgtgtaatataaagcatcaatatcacctaacacatcgtatataagatataacatgatagatagttggtcgattacattgctatactgcttagttttaactggtttatttttattgtagcagaaatgaactgaaaaaaaatatgggtttgataatcacacacatgaaagtaccattttgtaactcaacaaaagataaaacattcttcatcaaaaggcttctcgcttggtgtcaggttgtcacatgtgaccactgtgcaatgcgaagccatacttcttcagtgcacaaagtcatgtttaaacttggaaaagaggatgctacagtagtttcaaagttcagtgttgtggacccaggaaattttccataagtcttgcttgataacaatgtgattgtacaaaataaatgttcttaaggaaacaacttatgtaacatttgctacctttatgtaaacataaataaatcccatttaaaag

SEQ ID NO: 711 - DNA, 2089 bp, Homo sapiens
ctccaaaacgacatggatcacatctggttttgctcccagttttatccctcacacctagcgtagtggttggcaaatactgagaatctgtgtaacatggacttgggaggcagccagtctgaatttgaatcttggctcttctcttcactaactatgtttgactctggacaaattactttacttcttcttgcctaattgacttcatctggaaatggcaggaaacaaactagatataacaacagagaagaccattttacatggaggcatgaaaactttgaatgttgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcagattgcccgttgtaacaagagcaagcctcagaagtttattaatgatttaatgcaagtactttacacaaatgaatacatggccactcacagcctgacaggggcaaaatcctctacttcaagggacaaagctgtaaaaccagctatgaatcagaatgaagtccaagaaatcataggagtaacaaaacaattatttcccaatacggatgatgtttcaattaggagaatgatagggcaaaagctaaacaactgtaccaagaagccaaatttaagcaaaaatcttaactctcaggatattaaatagatccttttggtattacaggtatctgaaacaaagcaccttcaattctaaatctagcactggattttgttggagaatctgcagccttcctggcagtgagaaagacagacatgtgcagtgacaggctgtaagacatatgtaacattgctgagctctcctaagggaccaacaagcttgctgaagaagctgcatgtagattccaccctcagtactagtgatgcatcaaaccagagaatttctgccagtcaaataagcatgcaatatggtttctttggaaataagcatttcccaatccccaaatacccctctgtacagttaatctaacaggatagtcagagctcttatcatagcagccaaaacttcagcccataggttagtcattgtcctaaccaatcattgtacattgattattaccagtgacttcccattatagtttttggatctttagcataagcacatgcttgcaaaagtaaacagtgaaataattaatgttggcaaatatgagaacaacaaagtcagcccaaaatctgataatcatgtctaaccaagtaataatgttttagcaataaaattacaggattattctgttatctaaaaatgtataaaatgggaatatgaaaaaaatgacaacagcaagatgttttattttaatgttaagcaattccaccacacttctgaagaataaacctaagtttttgtgattgttaaaacaatgcatcaattttcagggaaatctttttgtttgtttatttaccagacatgttctaactttgtattgcccaaagtatattaaatacagatgtgtaatataaagcatcaatatcacctaacacatcgtatataagatataacatgatagatagttggtcgattacattgctatactgcttagttttaactggtttatttttattgtagcagaaatgaactgaaaaaaaatatgggtttgataatcacacacatgaaagtaccattttgtaactcaacaaaagataaaacattcttcatcaaaaggcttctcgcttggtgtcaggttgtcacatgtgaccactgtgcaatgcgaagccatacttcttcagtgcacaaagtcatgtttaaacttggaaaagaggatgctacagtagtttcaaagttcagtgttgtggacccaggaaattttccataagtcttgcttgataacaatgtgattgtacaaaataaatgttcttaaggaaacaacttatgtaacatttgctacctttatgtaaacataaataaatcccatttaaaag

SEQ ID NO: 712 - DNA, 2239 bp, Homo sapiens
atcctagcattatatctacagagcagaggcaggacctttggcaggagacacatcccttctcctgtgatgtgtcagttagtgtagagaagcaagctggcatggacttgagagccggggtgatgtctccagcggcagcgtgtcatcctggaggacattgtgtcagcagtgaagccctgcatccctgccagtcatcctgaaggacattgtgtcagtagtgaagccctgcgtccctgccagtccaggctttcttccttgtccttgccccgcctggtgaagctgacagacagagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttctcagggcagtatggcacccgttctagaaccttccaaagccagccccaccctaccacgagctccaatggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagcagagatcgcggacagtgatgaaagactggacggcattgctctaccaccaacaggtgcttgtggtgggccctgcactgttctgccgggtgggagtgcagcggtgaccctagtcttgcagagctcacctcagacaatgtcacaagaaaagggacagatggcagaaccctgggaggagcagcatctcgtgctcctgaacaaccttaccagagacagagctgaaacaggagctttgtcccaaaccagccaagacttcaagcaccattcattcctcataactcaggtctcagctacacttcatcatcagagagggattcgcaactttcccacgccaggctcagccaagtctcttacccttcacatctcttgcctctctctctgaaattatcttgcttatttatgtgtgtgtgtatcacccatctttccactggaatctgagccttgtgatgtcaggctgttaagatttcaggccctggtgaaaacatgttcaggatgccctctctcccctttgcccagcaagagtggactgattaaagttggacctgaggtttccatgaatatgcaaccgagtcattctgacgacagtgagtcctggcctcccagtgctgccagttaccagaagtgactccccttctcccatcagcccaaacccagagcctttatcacagaacccaagattgagaggagggtcaggctggttggacagtggccttatcatgggatggatggatcaggagccttttacagcgctctcctttccgctgtatcccattgtcttagatcacgtggacttgccttttcccctaataccgccccctcagtgctcttctataattggagaaattgtgtcaatagatcgaccaaagagatgcaggttgtactccatgagaatttaataaacgctagcgattcaaagc

SEQ ID NO: 713 - DNA, 1609 bp, Homo sapiens
ggacctttggcaggagacacatcccttctcctgtgatgtgtcagttagtgtagagaagcaagctggcatggacttgagagccggggagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttctcagggcagtatggcacccgttctagaaccttccaaagccagccccaccctaccacgagctccaatggtatggttgtcaacaaacattcagaaggctctcatgggggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacagtggtctgatgaaggactgcaaaccacagctcttgtgttttttgcaccatgggttttaaaatccgtcctctgcctcccacaaggagctactacccaagggaagggagaagattaattggtgacctttcgccgtgttaaaataggatgagtatgttgctggtcaaggcagaaacgctaacttccaactgtggtctgttaagagatctgctgggaaccttcagaagcactgccttccaaggcggggccacagcttggggtgttcagcacttgaggacgggtggagcttgttcaacccaaagatgtgtgcgatgaacggatctacacactggaaatacgtatcaaaactgcaacagcaaaatcatattttgtaaattaaaattgtgtttacttactgtga

SEQ ID NO: 714 - DNA, 1934 bp, Homo sapiens
atggagttctccgagaggaaaagaagcaggaaatcccagagcttcaaactggtgagccgagattatcaccacgaggtgtataagatcccagaattcagcaacgatgttaatggggaggccaaagagacacagcccatttttttaggagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttctcagggcagtatggcacccgttctagaaccttccaaagccagccccaccctaccacgagctccaatggtatggttgtcaacaaacattcagaaggctctcatgggggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacagtggtctgatgaaggactgcaaaccacagctcttgtgttttttgcaccatgggttttaaaatccgtcctctgcctcccacaaggagctactacccaagggaagggagaagattaattggtgacctttcgccgtgttaaaataggatgagtatgttgctggtcaaggcagaaacgctaacttccaactgtggtctgttaagagatctgctgggaaccttcagaagcactgccttccaaggcggggccacagcttggggtgttcagcacttgaggacgggtggagcttgttcaacccaaagatgtgtgcgatgaacggatctacacactggaaatacgtatcaaaactgcaacagcaaaatcatattttgtaaattaaaattgtgtttacttactgtgactactgttcagtctttattcagaaacctttttataggctttcttagcaaaaaaaaaatccatatctatggataatgtctcaatcttctgtatatatgttttattaatatgtaaatatttagattttttaaaattactatgttctttaaaaaagaattcaatgcaagcctggttgtgaaaatggtgtataacattgtgttgtggtatcaattcccaagatgctctttatgtctgatctggaagaatacaataaattactttaattg

SEQ ID NO: 715 - DNA, 2231 bp, Homo sapiens
atggagttctccgagaggaaaagaagcaggaaatcccagagcttcaaactggtgagccgagattatcaccacgaggtgtataagatcccagaattcagcaacgatgttaatggggaggccaaagagacacagcccatttttttaggagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttctcagggcagtatggcacccgttctagaaccttccaaagccagccccaccctaccacgagctccaatggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggtgcttgtggtgggccctgcactgttctgccgggtgggagtgcagcggtgaccctagtcttgcagagctcacctcagacaatgtcacaagaaaagggacagatggcagaaccctgggaggagcagcatctcgtgctcctgaacaaccttaccagagacagagctgaaacaggagctttgtcccaaaccagccaagacttcaagcaccattcattcctcataactcaggtctcagctacacttcatcatcagagagggattcgcaactttcccacgccaggctcagccaagtctcttacccttcacatctcttgcctctctctctgaaattatcttgcttatttatgtgtgtgtgtatcacccatctttccactggaatctgagccttgtgatgtcaggctgttaagatttcaggccctggtgaaaacatgttcaggatgccctctctcccctttgcccagcaagagtggactgattaaagttggacctgaggtttccatgaatatgcaaccgagtcattctgacgacagtgagtcctggcctcccagtgctgccagttaccagaagtgactccccttctcccatcagcccaaacccagagcctttatcacagaacccaagattgagaggagggtcaggctggttggacagtggccttatcatgggatggatggatcaggagccttttacagcgctctcctttccgctgtatcccattgtcttagatcacgtggacttgccttttcccctaataccgccccctcagtgctcttctataattggagaaattgtgtcaatagatcgaccaaagagatgcaggttgtactccatgagaatttaataaacgctagcgattcaaagcaacttgaatttacacagatcaactcctattatgttttgtaacctcaaatgcgtgaaattgattatccccccgaaagtaatatatacagatatgtgtgtatataaatatttatttctattttgttattggtgaaatt

SEQ ID NO: 716 - DNA, 6524 bp, Homo sapiens
ctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggtaaataaaacgcatttacattttcatcacctcctggaaaatacagcccacaaaactatttgcattgaaaacgattttaacattagacatgcagacacttgagcaaactgcttctgcagtggaccaggccccgtcattggagcttctcaaggccccgtactcagagatgtttttcatactgaatagaaaaacgtttttctcacactcttattttcataaaaatctcagaagagcaaatcctaagaactaagtatcataacattttgcctccccaaacctttggacattacaaaatatttttaacgtgaaatgagatttcaccttaaaacggggaccactaattttgtgtgatcaaattcatggctaggctgtcctctcccacctcctccaaacggccttggagccttgagcagtcaatcagtggacacccagtgaatactatgttttaactgagcgatttgaacaaggccagccatccggcgtgagtggcacattcctaataccaggaccagatcagctgaagatacccttccatggaagcatttgctgcacgctgttgtgttaagccatagacataattccaacttcatgttatttgactctcaagtaatgcttctgaccctggcttcctacctgtgtatgggttcatatctgagagccagaggggcaggtgtctgatcaatgagccttgtggaaaacaatgtatcccctccattggtcacaggactctactgacttccctccaaaggatatctgaagattctctgcccacaaaacccaggtacccccaaaaaccctcttactgaaaaggttcaaccgaatgttttttcctctagttttggggtggtctgtgttgattaaattcagcaaatattagtggagtctctaggttgtgtaggaacttgactaggccatgtattcattgacagcacatatcccaaaatggcaaggaaagccacattcgcaggcataggatgggcctgtgctagtgaacttcagagcttcagagcaacaggaaaattcagccgtgtaagagacacattgctttctctgccactgagtagctaagcaacagatcaatggacagataaatcaaatgagctacatagtgcaaaaagacctgcctacatcaagttcttcccatacagagtcattatataaaagagatttctgttcttctttggctgtgttttcacatttgtgaattaagagaattgaaatacgtgatctctgttgttccttcccaatttgtcattctctgaatatcagggcacgcatatcagcctcattcttatcacctgggcccaatcccagccgatccatgaaatcctaatcgtaatagacctagccttcagaaggcccttcaggggagcaccatgcctttctagctgtgcttcccaagtgccctcccaccctggccatctgcactgcctgtcctcctgtgtcatgtgacacagtgagcttttattatttgaaagccactccccttgaagtttatattcacccccaagtggtgagtacggaatgcctttgtattttcctatctgaagttggagatacgtttccagtgagaaaactgaggtcagagggtgctagaagagcctcatggaactgaaaaaaatgtcaaggaatctgagaatgagaaggaacttgagagatcctctagtccaatcccttctttttatccagtccttttattttacaggaaaaaaagcctgaggcccagaaacattaagtggctttcccacggcctcacagctggttgacggcctggccggaacccaggtccctcgactcccagccatgataccatatagctttctcatacctaagccaaagccagcttttctctgcatgtttcttaaagatcctaagagatgatggatgtgctaatccctttaggagtcctcttcactgtctcagtcttcacaattaaaatgttcgtcgtcagtcggcccggttcactgcagctgaaactcgtttcttccagtcttttctcaaactttacccaaggctgtgaggtcataatgaagaaaatagtataacacacttgcagatcttttcattaaactattgatagatatttgatacaaatcactaagcagcatgataaataaaaacgtttatcatttagaaaagaggaaaagaggccgggcgcggtggctcacacctgtaatcccagcactttgggaggccgaggcgggcggatcacaaggtcaggagatcgagaccatcctggctaacacggtgaaacccccgtctctactaaaaaatatataaaaaattagccaggcatggtggcgggcgcctgtagtcccagctactcaggaggctgaggcaggagaatggcgtgaacctgggaggcggagcttgcagtgagccgagatcgcgccactacactccagcttgggtgacagagcgagactccgtctcaaaaaaaagaaggaaaagaagtctcagattgatgctcaaattttgcagtaataatattaagtaatcttgatattcacctggatagcatgtctcttgattgcctccaaagtaaaatccccattctggttggcttctttgaatgcagtgctgctcctaacacccctcctcacatgtgccctttaaggactccacctttctcgcacatgtggtttcatccttgagcttgagcctcactggtcagaaccacaggatcgaccaagggctctgatacagactctcattatcccatttatctgagctagcaacagttagttctttttaaagattcaacaatgcttttattacttttttaaggtcttttttcctccttccaaagttgtgtatttgggggaagggcagggaaagggatgtaaatgcttaagtgtttctatgaaccagaagtgactagggtagggttacaggcaggtcaaatgacatttgtttggatgcattacatttaagcaaccttctgttcatcaggctttagcagaaatggattcaccttctgtagtgcatctattttagtttcccttaaccctattcactaagcctttttgagcaactaccaagaatcagccccgtgttgggtgctggtgtacaaatgccctcagactagtgtgagaggcagaaggaattacataaatgctatagcacagatgtgtggagagggtctggggctcaagaaaagccacccaggagctggggacaatttgcattaaaaaaaaaagtatagagaaagtgaaatcaaaacagtgctttctaaaatttaaaatggggcttccaaatttgaaatggggatgttcatctagacttagcaattgtcataaattggcattttacatacttttaaaaaattaataaaagtgtaaggaagaacatttcaattgcttttaccacccacagacaaccattattggatgatttttctcaaatgtttctccattttatttatttatacagtggagatcaaatatgtaaaattttgtttcctacatgtttttttgatttttacctaacaagcatttttccactctatggcaaatcttcatatgcattattttaatagctgcataatattctgttttgcaggtaaattatcttttaggccattttccatgactggacaatatgtggatatactctaatagtaacacacattcgtggcctttctcataaaaaatcattacaaatttccaatttctacaattgctcatggaggacaactaaagccttggctaaaaacttagcgacttaagtgtgaaacacagacacctccccagtaaattgtttacttgtccagaacgcccacctccagccatgtcacagaaccatgtacaactcttccttagagaagcggctctccgccttcattttcttgtctctgttgtaggtaatatatttgacaccaggagagaaaacacggaggacacagaaccaggtttcattgcctagactttgattttagtgacattgttgagtggcatatgtaacttccgtttgaatttccacaaagatccacgtagcatttcaggttcctgcaaagtgtgggtgttctgtcaagcttacctgtcatgtttgaatagtttcatatactttctttgtaatgtgtgataaccaagcctccaatctggtataagattttttaaatcatttttagggttgatttgttaccctttaaaagtccagcatatgattcagtgagttcattgtccattataaagaagtggttctctcttccctgttttcattcaaaacctcagtatgaatatagagctttgaaacgtatttattttaatgtaaattgcttagatgcagtataaaggagaatggctctttccagtgctgagagagcagttgtgaaggccaagattaattagaccttcatcatcttagaagatgaaaaagttgttttgggagataggatagctctgacctgtaagatgaaatcattcatgacgtcagtgccccccaaatagccatttgtaactgagtaagtgcaaatgacctatgagttcttaggaaagaaaaacctttcacctaagttgcgtcaacacaatgacaaaataactaattaaaaggtgagaaaaccagtaaattatctacatgatacctgacagccattttaacagatggtcttaacggagtgctacagggttttggcaccatgtggtaactagctaaaaatgtacttaatattatgtcatttatttggttcctagtatacttgccctccactttatataaaactaatttatgaaaatctggatttattttaaaaagatatcttgccatgaaggtatttgttttatagaaatatttacctccagatttctttctctaataagatggtgaatttaaaacactgtgttatttagaaacactgcatttacacttcatttattgtataaagcaaattgcattgaatcttcgccacttgacccaaaggccaaaaattggcatgagaacaatttggactacacatcaccaaacccggggttcacacctgtccactagcagttccagtgccttcccctagccctggatttggcaaagcacagaatgttaagagctaaaagttattgtagaggctactcagtcccacccgggaaactgaggatgaatgagggtaagcggttgcccagagcccgttaacccctccgtggctggggccctgcctagaacccgaatttcctgactaccctgtccaaggtattcatgtcacatcacactgaaacgctaaacctagagataggagaggccctctgggataaatccctgttccaccaaagaccagccagtcatcaaagatgagagaaggcatccctgtactgtaacaaaaagctggctttaggcgtggcttgtagaatcaatctaactactagacaagttacatctcatatatgtgtggcttctttttcttcttttggggggctacaaggaaggtttggagaaattatttccatcatacctttttgttagcctttttccatttctggccagtaagtaatcccgttcctgacaacagtccctttgttttctcaagtggtctgatgaaggactgcaaaccacagctcttgtgttttttgcaccatgggttttaaaatccgtcctctgcctcccacaaggagctactacccaagggaagggagaagattaattggtgacctttcgccgtgttaaaataggatgagtatgttgctggtcaaggcagaaacgctaacttccaactgtggtctgttaagagatctgctgggaaccttcagaagcactgccttccaaggcggggccacagcttggggtgttcagcacttgaggacgggtggagcttgttcaacccaaagatgtgtgcgatgaacggatctacacactggaaatacgtatcaaaactgcaacagcaaaatcatattttgtaaattaaaattgtgtttacttactgtgactactgttcagtctttattcagaaacctttttataggctttcttagcaaaaaaaaaatccatatctatggataatgtctcaatcttctgtatatatgttttattaatatgtaaatatttagattttttaaaattactatgttctttaaaaaagaattcaatgcaagcctggttgtgaaaatggtgtataacattgtgttgtggtatcaattcccaagatgctctttatgtctgatctggaagaatacaataaattactttaattgaa

SEQ ID NO: 717 - DNA, 4782 bp, Homo sapiens
atatttcaggggatatgaatcccctacattaagtaaggattatgagggctacccagccccagcaatgccagattttcaacctggggataccacagtaagactagacaaaagaatgtctcttactgcaatatatgacaagaggagagagacagattatagtgacaaaggatataatttagcttttgtttctcaagatgaacaagaaaattcttcctttactatattatacgaagagccccttcaagaggaggacaagtatgcttccgcagaagcaagacaaacacagtctgtcttgtttcatgatacgtccgctgacagcatgcctgttctggcatgtgaaaggtctgagagtagaactgaccttgtccatcactttgaaaaaggtactaaattaggtgagacatttgatagtgatagttcagaaatgttcttatcagtggaggccaaaaggtacaaaatttatcctttagcattgtctcccatttatgaggatgacagctcacaggaggacattctatctagtgaggtttcacctggtcaccatggccccaggaaatcaagagacagtgaaaaccagtcctcttctgttttatcccttctccagtcagtgtcagaacgtttaaagatgaattttgatgaagatgacagagaggcagctgatgaggaagaagaggaggaggaggcagcagtattgcataaaggagatctgagagctggaagtggggagcgtgttaccttccagttgccagatccttccatcacattttaccctgatgaccaggagagcgttggaatttctaagaattcatatgtgatgccaaatgaacctactacctccaatctgcaagttggtctgtggccagaaaagacctcgtttctccagaaatctgaccttacttctaaactacattcttctttaaagagtgcttatcatcagtatctgcagacttcccaaagtcattcctcagaaaaaggagccagatttggtggaatttttcaggaaccagtgtcaaaatatttccgtgttcaagacagcccaggcagattgagcccatttatagagaatgttgacaaacaaactctgagatgtaacccaagacctgggaagatggttatctatgatctccatgaaagtacatataaacaagaagtctactgtaatattcctgatgctacatcatggtcttttccaaatggagttctaataaaagttgtaaggggctgctggattttatatgagaaaccacatttccgaggtcagaaatgtgtgctagaagaaggggaaaaggtgttaaatcgtgactggattcttcagaacagaaggcatccacaaagaaactttatattgggttctctcaaacgtgtcttaaaggactgcagcattccagaaatagagcttttcccacaatctgacccagcctgttgtcctgtctacatacagagagcagtccccaatttggaagaactgaatatctccaaatctgtgtccttcactgtgaagtcaggagtttggcttgcctacccagatattaattttaagggacaagctacagttctggaggaagaccatgggctctttgagatttctacagcagaaatgaaatcattacatccgcttcaaatgggtggactgaaagtggaaatgcccatgaacttaaaggttattatttatgaaaaacctcacttccatggacaggctaaagagtttagtgaacatatagattctgttcctaattttttgaaaaataatggagattttcacagaattggatcaattcgtgtcattggtggagtgtgggttgcctatgaaaaagaacattttaaaggccagcagtttctgcttgaagaaggagactttgaagacagtaatgcttgtggtgcattaagtagccctatcttgtctttccggtacttacaagctaattttatagaatcttctgtcacactatttgaatctgacctagaaagtgggaagtttattgacattacaaatcaggaaatttctgatttggaagaaattggctttggcagtaaaacaagatccattcatgttaaaagtggagtatgggttgcctaccagcaaaagttcttctgtggagaacaatacattttagaaaaagggaaatacaaatgcttttttgactggggaggatcaaataatataatcatgtcgatacggccaatccaactggaaccacttgggataaatgaacctccgcatttgctcaaagcattcagcaaaccagggttccaaggtgaatgtatagattttacagaagaaacttctgatttgacttcactcatgccatgttcttttaaagttcttcgaggttgctggctcctctattaccaagaagacatgtttgttaatcactgtgtgttagaagaaggcctctatgctgaccttacttcctgcggttgcccagcatctaaagtcaaatctctcaagcccattgactatgtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaagaatactcagatctggtactactgccgaggactctttaaatccaaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtcatacttttgcaaacagatgagtaattttttagcaacacctgaaaatatactaaactttcctagataaactttaaggtttctatactgaggcttttataatgaacgcacctcgttaagtatttatacttgtaactaaccccaggcagggacctcagctttgttaggaataaggcacaagaagtattttctgtagctattgtttcctcagtccttcaaactaaaaaagtacaaataaataacctatggccaaacttgcactgttacgtgttaaccaagacatccctttaggtgacaagactctataacagtggttacctgtctccatgttgacacttcatcctagatttaaggagaggcatcaatttttttttttttttgcctcaagagaaatttcaaatatccaaattaaaacacagtagcatttgaaccttgaccttaccatctctttaagtaaacgtggagttgatttctctactaaataacagaaacctcagtttttcactcccattgtaagtaacttttatttaagtaagtaaaatcaggtaggaaatcacctttgacttagcttccagtagtcattaccaccttttactgcacaattcacaagcatgttttcctggtgaattggactgaaaattacattttgacaactttttttccttttatccccaacttttgccagaaagcagaaaaatgctctatttttataaagaaagattaaattctccaatgatattttaaaaaatatcaacctacatgcactttagaatgtaaaataacaatgactattttaaactcgaagacccactattttgagtattttttatagactttaaatactgggtttttttcctccttcaatctcaggcttttctccatcttttaagcagcctctgtaactcccttttgtccataggtgttgcgtgcctctcatctgtggggaagtattatttaataaaatttatgttacaggataactttattttaatgggcatgggcttgtctatacacaaaggtatgtatattttcattataaaaaaccagtttaaaattttttcttattttaattgtttgaaatttttctagagccaaagaagctctttaaagaagttgtttcttccaaagaacaaagccaggttaatgacattcaattctaaatgatacattggaattgtgccttttctaccacactggattaaataaacttgtcaaaata

SEQ ID NO: 718 - DNA, 2342 bp, Homo sapiens
atgaatgaaaaaaaaaaagtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaagaatactcagatctggtactactgccgaggactctttaaatccaaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtcatacttttgcaaacagatgagtaattttttagcaacacctgaaaatatactaaactttcctagataaactttaaggtttctatactgaggcttttataatgaacgcacctcgttaagtatttatacttgtaactaaccccaggcagggacctcagctttgttaggaataaggcacaagaagtattttctgtagctattgtttcctcagtccttcaaactaaaaaagtacaaataaataacctatggccaaacttgcactgttacgtgttaaccaagacatccctttaggtgacaagactctataacagtggttacctgtctccatgttgacacttcatcctagatttaaggagaggcatcaatttttttttttttttgcctcaagagaaatttcaaatatccaaattaaaacacagtagcatttgaaccttgaccttaccatctctttaagtaaacgtggagttgatttctctactaaataacagaaacctcagtttttcactcccattgtaagtaacttttatttaagtaagtaaaatcaggtaggaaatcacctttgacttagcttccagtagtcattaccaccttttactgcacaattcacaagcatgttttcctggtgaattggactgaaaattacattttgacaactttttttccttttatccccaacttttgccagaaagcagaaaaatgctctatttttataaagaaagattaaattctccaatgatattttaaaaaatatcaacctacatgcactttagaatgtaaaataacaatgactattttaaactcgaagacccactattttgagtattttttatagactttaaatactgggtttttttcctccttcaatctcaggcttttctccatcttttaagcagcctctgtaactcccttttgtccataggtgttgcgtgcctctcatctgtggggaagtattatttaataaaatttatgttacaggataactttattttaatgggcatgggcttgtctatacacaaaggtatgtatattttcattataaaaaaccagtttaaaattttttcttattttaattgtttgaaatttttctagagccaaagaagctctttaaagaagttgtttcttccaaagaacaaagccaggttaatgacattcaattctaaatgatacattggaattgtgccttttctaccacactggattaaataaacttgtcaaaatatgg

SEQ ID NO: 719 - DNA, 578 bp, Homo sapiens
aattgacccattccatggaaaaagatagttagaatcctactttactccaaacacaaaaataagttccagatggattaataacaagctaaatgtgaaaagcaaactttacaacttagaagaaaatataggaatctaccctgatgatactgcagtaggatggatttcttcaaacagaaaaagcacaaatgaataagaaaaaggtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaag

SEQ ID NO: 720 - DNA, 10565 bp, Homo sapiens
ttccggggttgctctggatccgctggttccgtaacaacatcccgttggcttccctcaggcggcgggaccagtgcagccgccgcctcccaggatcgtccgccggtcagggcccttgccctccccggcacaggccaccatggccaccaacccacagccgcagccgcctcctccggcgccgccgcctcccccgccgcagccgcagccgcagccaccgccgccgccgccgggccccggggctggccccggcgcgggcggggcgggcggcgcgggtgcgggcgccggggacccgcagctcgtggccatgatcgtgaaccacctcaagagccaggggctcttcgaccagttccgcagagactgcctggccgacgtggacaccaagcctgcgtatcagaatctgagacagcgtgttgacaactttgttgcaaatcacttggcaactcacacatggagtccgcatctcaataagaaccagctaagaaacaacattagacaacaagtcctcaaatcaggaatgttggagtctggtattgaccgaattatttctcaggttgtggacccaaagatcaaccacacattcagacctcaggtagagaaagctgtgcatgagtttttggccacgctaaatcacaaagaggaaggaagtggcaacacagctcccgatgatgagaaaccagacacttcccttattacacaaggtgttcctactcctgggcccagtgctaatgtagccaatgatgccatgtcgatattggaaaccataacttctcttaaccaagaagccagtgctgctagggcttcaacagaaacatcaaatgccaagaccagtgagagagcgtcaaaaaaacttccatctcagccaaccactgatactagtactgacaaagaaagaacttcagaggacatggctgataaagaaaaatctacagctgactctggaggtgaaggactggaaacagccccaaagtctgaagagttcagcgacctcccctgtccagtcgaagaaattaaaaattacacaaaagagcataataatttaattctgctaaataaggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatgatgaagagaagaacaaacagaataaaacaaaaactcaaactagtgattctagtgaaggaaaaacaaaaagtgtacggcatgcgtatgtccacaaaccatatctttactcaaaatactatagtgattctgatgatgagcttactgtagaacaacgacgacagtccattgccaaagaaaaagaagagaggcttttaagaaggcaaatcaatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagtctaaagttgaagacaaaccttttgaagaaactggtgttgaacctgtattagagactgcttcttcttcagcacatagtacacagaaggattctagtcatagagccaagttaccattagcaaaggagaaatataagagtgataaagactccacttccaccaggcttgagagaaagttgtcagatggccacaaaagcagaagcttaaagcatagtagtaaagacataaaaaagaaggacgaaaataaatcagatgacaaggatggtaaagaagttgacagtagtcatgaaaaggccagaggtaatagttcactcatggaaaagaaattaagtagaaggttgtgcgaaaatcggagaggaagcttgtcacaagaaatggccaaaggagaagaaaaattagcagcaaacactttgagcactcccagcggttcctcccttcagagaccaaaaaagagtggtgatatgacattgatccctgaacaagagccaatggaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtccaaaatgaaccctggggagaaagaacccattcatagaggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagttacaagtgctggaacagagataagagcaggatctataagcagtgaagaggtggatggctcccagggaaatatgatgagaatgggtcccaaaaaagaaacagagggcactgtgacatgtacaggagcagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgactagcacaggcgcaaaagaggaagacgaggaaggggaggatgttgtgactagtactggaagaggaaatgaaattgggcatgcttcaacttgtacagggttaggagaagaaagtgaaggggtcttgatttgtgaaagtgcagaaggggacagtcagattggtactgtggtagagcatgtggaagctgaggctggagctgccatcatgaatgcaaatgaaaataatgttgacagcatgagtggcacagagaaaggaagtaaagacacagatatctgctccagtgcaaaagggattgtagaaagcagtgtgaccagtgcagtctcaggaaaggatgaagtgacaccagttccaggaggttgtgagggtcctatgactagtgctgcatctgatcaaagtgacagtcagctcgaaaaagttgaagataccactatttccactggcctggtcgggggtagttacgatgttcttgtatctggtgaagtcccagaatgtgaagttgctcacacatcaccaagtgaaaaagaagatgaggacatcatcacctctgtagaaaatgaagagtgtgatggtctcatggcaactacagccagtggtgatattaccaaccagaatagcttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaaccgggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgcaggaagaggacagaaagagagcactttacacctcataaatgcagaagagaagaatgtattgttgaactcccttcagaaagaagataagagcccagagacagggacagcagggggcagtagcacagcaagttattcagcaggaaggggcttagaggggaatgctaactcacctgcccacctgagaggaccagaacagacgtctgggcagacggctaaggatccctctgtcagcattcgctatttggcagcagtaaacaccggtgctataaaagctgatgacatgccacctgttcaagggaccgtggctgagcattcctttcttcctgctgagcagcaggggtctgaagacaacttgaaaaccagtaccaccaaatgtattactggccaagaatcaaaaattgctccttcccacacaatgatccctccagctacttacagtgtagctctgttggctcctaaatgtgagcaggacttgactataaagaatgattatagtggcaaatggactgatcaagcatctgctgagaaaacaggagatgataacagcacaaggaaatcattccctgaggaaggagacataatggttactgtgtcttctgaagaaaatgtgtgtgacataggcaatgaagagtctccattgaatgttttgggaggattgaaactgaaagccaacttgaaaatggaggcttatgtgccttcagaggaagagaaaaatggtgaaattctggcaccaccagaaagtctgtgtgggggaaagccaagtggaatagctgaactccagagggagcctttgttggtgaatgaatcactaaatgttgaaaattcaggcttcagaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaaagaggaagacctcgcaaataccctgtagaaacaacgttaaaaatgaaagacgactccaaaacagatactggcattgtcactgtagaacaatctccatctagcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaa

SEQ ID NO: 721 - DNA, 3239 bp, Homo sapiens
atctggagcgcgcttggaatccagcaggcggttgctgccgcgtcttccacaacctccgcggtctggagctggcctcccccaccgccgccccaaccaccggccccgccgccatcaccaccaccgtcacctccgccgctgcctccttggggccctcctccttcaccgcccccttagccacctctacacattctaggctttctgtcctggagaagaagctataatcggtttccttgtgggcccggtgcgcagccatggcggacggtggcggcggcggcagcggcggtgcgggcccggcctcgacccgggccagcgggggcggcggccccatcaacccggcctcgttgccccctggcgaccctcagctcatcgctatcatcgtggggcagctcaagagcaggggcctttttgacagcttccgccgggactgcaaggctgacgtggacaccaagccagcttaccaaaacctgagccagaaagcggataattttgtgtcgacacatctggacaagcaggaatggaatcctccagcaaacgacaaccaactgcacgatggtctgaggcagagtgtggttcagtcagggaggtcagaagctggagtggacaggattagttctcaggtggtggatccaaaactaaaccacatcttcaggccacaaatagaacaaataattcatgaattcctggtggcccagaaagaagcagctgtgccagcactccctccagagccagaaggccaggaccctccagctccgtctcaggacacttcctaagaatatgcctgacagcttttgaaagcgctatttaatttttggtgaagaaatggattcggttacataagagtgcagtttcagattgaagataagccaagttcatcactgagctcaagatttccacctcgaccatgagcagtgaccagattgaaagggaagcaagttcgccagagagaaagttgaccgtggcaccctcctgcattgcgctgccatttggccagcctttccaagggcatgacaccaaacacacactacagagagggaaacactaccgcgacccaggattgtcctgaaacagacatctatacttgaacatggagactgcacatggattttagggtttgtgctctgagataaacgaaagctacagcgagagaacataaccaatcccaaagacaatttcaaagaacaatgacagtaaaggttaactgggaggaatatttgacagtacttatttgatattgtctctcagagttgcaaactagattgtacacaacattagtgtcagatagctttgaagttgtgaccttcttgtacatgaatcttctagccagtttcctttcctttgtaagagataacaaagcatgaaaccctagaatgagtgagaagttcagacattaggtataaggaaactcatttgcagactctctgtccaagaatgcttcctgtcttgcaggggctagtgagtcttgggtgtgtttatgttatgctcacatttgtgttttatttgaaaagtggatggtcaataaatggcttatctttcaactgcaacaacaaaaaagaaatgcagatttacatccttttcctctttaagctccgtcagttttctgatatttctagaaggtcagacacctggcatggtttatgaggcccgtgataatggggcccctggtcacctctgctgccccgtacactgtcatttctcatatgacaaccatgcccatgactatcctggacaccctgtgttccctctgctcactgtgaagggaatgccctcaaccactcctaccctcctttaagactcagctcctgaggagccacacatcgtctaagcaggagtgacagactccttcctctgtgctcccatagatctcataagggatgaccacacttactatagtagctaggtctgacgaagcacttgctctattgctctacagctggcagtgtactaaacgcttaacttcgcttaccgtagtaagtcctcatgatctaattgaagaaatcgtatctttattcccatttttattcccatttataaatgtagaaaccaaagctcagacactgcctaagtggtggggctggggctgagcctgtattgagcacagagccctcacttttaacccttttaaccatgcttttagccacaccacctcaccacagtgaactgtctttgcttacagatctgtcatccccacttaaatgtgagcttcctccagggcagggatttgctttgttcatttcttttccttaaccccaggacctagcacatcacaggagctcagcaatttgtagaaagaaaccagttctggatttgtcttttccaacatttaatttctcagatggcagtatttatcatctaaaaagtgaacaaaaattaattttgcatctagtgtctacatgtctaagcaagaaagagctttcttatccctggaggtattttatctgtaatgtttacctatgagctattttaaatgattcttcaaaatttagagtccagaaggtagaagaccatgtcctttctgaaaatgtcccttcctttcccaggtaccaggctctttttaaaattagcttctgaatatgaacaacccagctctttaaagtttaatgtcccagccattttaattgtttctttcgaagtacaaaagagcagctgggccacatcggcactaatcacttgccaactttcctttttacaaaaacagctaagctctttctgagatttaaaatcactccatctgagaccccagcttggcacctatctttgcactaacataaaaggaacctaatttctgcttttaagaaatgtgttgcggaagtgatttttggtttggggtttgttctccttcttctttttaaaaataacgtaataaagtgtaatacaacttttaaagttttttttttcctttaccagttctctattctccttttctacttgaattgtcctgagacaggttgccagataaaatacaggttgctcagcaaatgtgaatttcagagaaacaacagatactctcctagggcatggaccgtgcaatatttgaaacatacttgtattaaaaagttatttgttgtttatttgaaattcaaatttactggggccccatgctttagtttgccaaatctgccaaccatagcctgaatgcttcccgttcccaccatgagtttggcaaatggaaaatgctaacctatgcgatggacactgctgtattctgaaaatgaatatgtaaataaatcaaactaccgtga

SEQ ID NO: 722 - DNA, 859 bp, Homo sapiens
aggactgcattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacacta

SEQ ID NO: 723 - DNA, 1012 bp, Homo sapiens
cttcctcccggcacagaaggcctccccctctcaccagggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccaggggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 724 - DNA, 9683 bp, Homo sapiens
atttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtaggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgttttgtgttttattggcccttttctttattcagccccttaatctattttcagtcttctggcacgtaatttttttcacagttattattcttctattaacaaattatttttatctttcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatctatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgacaata

SEQ ID NO: 725 - DNA, 1785 bp, Homo sapiens
aaagagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatgcctctgtcagaatcaaagactaagcttaagagttcctcgcatatatcgttgtgcacaggatcaacatgatggtgactgggaaaaaattacttcaagtaacatgcttag

SEQ ID NO: 726 - DNA, 2741 bp, Homo sapiens
gagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaactccagggaaatttagatggtctattgatcaactagctgtaataaatcctgtagaaatagacccagaagatattcatcgtcaagctttatacttaagtcattctcgaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatgcctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataa

SEQ ID NO: 727 - DNA, 4089 bp, Homo sapiens
gctgttcggctcagctgcacggctcggctcggctcggctcggctcggctgcgcggccgctgacgggcgtgcgctgggggcgcggggcgcggggcgcgggcctcggcggcggcggcggcggcggcggcggaagccaggtgcccccgcccgccctgtcctctcgacgaggcggaggcgtcgccgcgggccaggcctcggactgccgcgtcggagtggacgcggggggcggcggcgcgggcggacgcgggcggcgcgaagcagcggggcccgcgggggcgccccggccgggtcggcgcggacggcactcggcggacgcgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctgtggagaagcagctccacctctgggggggctcggggcagaggggcggtgtcttgtagcgggcggcagcgccagcgcccctctgtcaggctggggcaatcttggttttgtgtccaaaggtgaaggggtaggaggagggccctcagctggccctccccacacacaggacggcaggggcactgtgaggcttttcttattaaaatgaaaaaattgaaaaaaaaggacaaagagtcggtggcgctcctctgcagggcgttctgtgcagagcgaggcccagggcgcagccctcagagggctgcaggcccaccctgcccagtgcccgccgccgtgcttcaccccagctccagcttctgtgttcccttccgcccatgtgcccagccctcccaggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaa

SEQ ID NO: 728 - DNA, 3277 bp, Homo sapiens
tgttcggctcagctgcacggctcggctcggctcggctcggctcggctgcgcggccgctgacgggcgtgcgctgggggcgcggggcgcggggcgcgggcctcggcggcggcggcggcggcggcggcggaagccaggtgcccccgcccgccctgtcctctcgacgaggcggaggcgtcgccgcgggccaggcctcggactgccgcgtcggagtggacgcggggggcggcggcgcgggcggacgcgggcggcgcgaagcagcggggcccgcgggggcgccccggccgggtcggcgcggacggcactcggcggacgcgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagagtaaagcaatgttcagtaaaagcctggatatcgctgaggcccatccccaattcagcaaagaagacaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaa

SEQ ID NO: 729 - DNA, 3576 bp, Homo sapiens
agtctcaggctggctagttcctccttcctggtcactgagccagccttgctgaggggagagcgggttctggacgtgctctgagcttccttcctcacagccttgctcctgggccagatcagcaggaaagcagccagtgccccgccatggcctgcccgggtggggtcctgaagctggggccggagcagggggcacagttctgccccatctggccctagtttggggagggagcctggtagggcaccagcctcaccccatgagccctgagggccaccccagccgatgggcacgtccccgccggccctgcatctgtccttcctccctctgctccccaagagagcccaggtctggcccagcggtgggcaggggaggggccgcacatcacagagtgccagctggccacactcccggcccacagctgctccagccgcacctccaccttcctcaaggccagacctggctctgcctgcagcccagcccagcaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtgacgagaagaacgggcaggcggcccaggcccccagcacgcccgccaagcggagtgcccacggcccactcggtgactccgcggccgctggccctggccccggaggggacgccgagtacccaacgggcaaggacacggccaagatgggcccgcccaccgcccgccgcgagcagccttagacacactagcccccccccccagcacagcactgacagcggctgcctcgccgcccgccgcccgccctgccccgagtggacccgcggccgcgccgcccgtccgtccagactgttctcagagcctgggaggaaaggaaaggggcgttggggccggcctgtgggctgcgccacccgcgcccgctctcttttctctctgtctctgcctctgcctgtctctgacagcatcgcttgtttccactctgataccaggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaagaattcctgcaagatatttttataaactttt

SEQ ID NO: 730 - DNA, 2091 bp, Homo sapiens
atgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagagtaaagcaatgttcagtaaaagcctggatatcgctgaggcccatccccaattcagcaaagaagacaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctga

SEQ ID NO: 731 - DNA, 3586 bp, Homo sapiens
tgttcggctcagctgcacggctcggctcggctcggctcggctcggctgcgcggccgctgacgggcgtgcgctgggggcgcggggcgcggggcgcgggcctcggcggcggcggcggcggcggcggcggaagccaggtgcccccgcccgccctgtcctctcgacgaggcggaggcgtcgccgcgggccaggcctcggactgccgcgtcggagtggacgcggggggcggcggcgcgggcggacgcgggcggcgcgaagcagcggggcccgcgggggcgccccggccgggtcggcgcggacggcactcggcggacgcgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggcagcccattgagtaacttctttgacgtaattaaacaacttttttcagacgagaagaacgggcaggcggcccaggcccccagcacgcccgccaagcggagtgcccacggcccactcggtgactccgcggccgctggccctggccccggaggggacgccgagtacccaacgggcaaggacacggccaagatgggcccgcccaccgcccgccgcgagcagccttagacacactagcccccccccccagcacagcactgacagcggctgcctcgccgcccgccgcccgccctgccccgagtggacccgcggccgcgccgcccgtccgtccagactgttctcagagcctgggaggaaaggaaaggggcgttggggccggcctgtgggctgcgccacccgcgcccgctctcttttctctctgtctctgcctctgcctgtctctgacagcatcgcttgtttccactctgataccaggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaa

SEQ ID NO: 732 - DNA, 3163 bp, Homo sapiens
tgttcggctcagctgcacggctcggctcggctcggctcggctcggctgcgcggccgctgacgggcgtgcgctgggggcgcggggcgcggggcgcgggcctcggcggcggcggcggcggcggcggcggaagccaggtgcccccgcccgccctgtcctctcgacgaggcggaggcgtcgccgcgggccaggcctcggactgccgcgtcggagtggacgcggggggcggcggcgcgggcggacgcgggcggcgcgaagcagcggggcccgcgggggcgccccggccgggtcggcgcggacggcactcggcggacgcgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcaggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaa

SEQ ID NO: 733 - DNA, 1764 bp, Homo sapiens
aagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcac

SEQ ID NO: 734 - DNA, 857 bp, Homo sapiens
atggtaattggaaatctgagctcacagtgacgtgacccttaggagacccagagccaatgcgtggattagtccctcctcctagttgcagtctggtagttgtcgctggccgtgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaaacaggaaaaaaactcaacatggaaaatgtccccaaggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagca

SEQ ID NO: 735 - DNA, 860 bp, Homo sapiens
caccctttccagatacacacccgtttagtgcgagaaatggagcggttggggagaggatctcccgagggggctggattgagaatgggtaccatttgagatctcctaggaggccggccatcgggcaatgtctgatggagtccagccggtggaggagactgaaaggaaacagcctgcttcctgcaggtccgcgggagggaggtctttaagtgcgtttgtgcagccgatttcaaggctaagagagaaagactgcctctgatccctgaaggaagaaaaaaaaaaaaaaaacaggaaaaaaactcaacatggaaaatgtccccaaggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagcagtct

SEQ ID NO: 736 - DNA, 3171 bp, Homo sapiens
gcctgctgctggccgggcgggggacggggccgggaccggagccggagctgcggggcgcaccggctagacgcgcgcgggattctcggcgggcacgccccgcggaccatgagcgtccccagctccgggagcagccgcggcgcgggcggtgcgaggccggccgcgcggcgcctttgagccccagccggaggtccagagatcctgagagcccgagcgcccagcgccgcgccgggagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaa

SEQ ID NO: 737 - DNA, 3200 bp, Homo sapiens
gagcgcgctgggactccccgagacgtggcccacggcggggagcgctcagcgattggcggccaggcatcttgctcggtggcactcgagcggcatcttcccgggcgctggcctcgcccgaccccctgcccgtcggagctgctctgccggccaccccgccctgtcccgcccgtcccctcttcgcagaagccggccggggtcgggcagatgcgagggcccagagcgctctggtggaagcccaaggctccgaggaggcgagtttctccgagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtg

SEQ ID NO: 738 - DNA, 3217 bp, Homo sapiens
aagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagagctgcttcatctgacccaagctggcctggagaaaggaggaagaggcaagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaa

SEQ ID NO: 739 - DNA, 2823 bp, Homo sapiens
agactagcctgggagaaggagccgactcactcccccggctgccgacttccctgacttctgggcagaaacagcacagctgctgtggtgggctagggctttaacgtccgaagccccctttcttttaaccctaaagaaagtgtgtggtccccgggactgaagaccgaaagatgcctaaggaatgcagtgctttccacgccctctcagcagctctgtgctgcttctatcaccgcaagtctttcattggagtcaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaac

SEQ ID NO: 740 - DNA, 2160 bp, Homo sapiens
ggagtccagccgcagtggtcactgcttaaatatcacttctcgggagatatttccttttgtaatttgccctcggtcttgtcttatcttcgaaaggttgctggaatttctctgttccttggagtttgggggttttttgatttgttttttctttggtgcttgtaaagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtg

SEQ ID NO: 741 - DNA, 6102 bp, Homo sapiens
cgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaaccactctg

SEQ ID NO: 742 - DNA, 2238 bp, Homo sapiens
atgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaagagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggtgttt

SEQ ID NO: 743 - DNA, 1560 bp, Homo sapiens
gctgtctgcagtctcaggcttcctagcagccctgataagagaagtagagcaatgcaggtgacattaatccttgcagaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggtgttt

SEQ ID NO: 744 - DNA, 2178 bp, Homo sapiens
atgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggtgttt

SEQ ID NO: 745 - DNA, 1417 bp, Homo sapiens
acgggggaggagttccgggcacgcggacgggggtcctgggcaccgggcgagattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagc

SEQ ID NO: 746 - DNA, 2156 bp, Homo sapiens
ctgccgcggccccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcat

SEQ ID NO: 747 - DNA, 2120 bp, Homo sapiens
tccgggcacgcggacgggggtcctgggcaccgggcgagattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagt

SEQ ID NO: 748 - DNA, 482 bp, Homo sapiens
ctccccacagtcccgttttcctgtccatgcttggatggatccagccgagccgtcagccgcagctgcgcgctgctcccccgactcgcaccccctcggcgaagcgctgcattttatgtaattttctgccgggctgctggcttgtgggggatgtggctgggtctcggcagccttcagcgccgcagacgctccggcaacgccagcatacgaggcccccgccccaggagcgcgggtccgggcggcgttcccctctgcgggaggcgcggcgagccaatcctcactttaaaagctttcctgtcctcgaagcgaggggtcttccgtgcggggcaagacgcactggccccagacgaccggtccgtgaaatgacccttccgagcgacccggagcgggcgaccttgcccaacccgcgactcggggcccctgcggtcccgcgtagaggacccaggtcccacggggggcggcggtgaatcgccccctcttgtggc

SEQ ID NO: 749 - DNA, 541 bp, Homo sapiens
gtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctgccaaccagagctctgggcacagattctggtggctccctgctggccctcttgggcctctgctcacacctgggaaggggctctctaa

SEQ ID NO: 750 - DNA, 4599 bp, Homo sapiens
catgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctattgcagcctgttcccggggcgcttgcttcctctgcccgttctctatacagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaagaaaacagacatcaaaccctgcctgaccttctgagttgtggtcctcaggtatgaggcctgagtatatacttggccttggagacaaaagaccagtgtgatcaagggcaagggcaagttacttaacctgagcccctggttcctcatctaaaacatggaattgatcattataagacctggctataagctgtaatgaggtgatccatgtagacaccttagggctattgcctgagacatggtgaccagcactcaggagacattagtgataaaccccacaaaacccattccagttattaagctcaaggaggccttagtactgttattcttcactacctctcagaatcaaaagtggctcatttagattgagaggctggaacagtccaaagctctcccagctaataagtgacaggactgaggctgcaacccagacatctgattcatgtcagcgttagttccactgtcacataagaaccacatgagtccttccatcatgtaacttatgagcctgttagaaagaggtggacagattagagagacatgtgaagggcctcctttttcatgatgggaaactgaagccttgggggagtattttacctactcaggagtattttgcacttgtgactacctcactatacccaggacagagaaagcccatagtgccctgtcaggccacaggggcttgctggctttttgtgtctttgcagccccctttaaaacctgacgtgcagtacacgtgagcattctagaacctgctataccagggcttagccgacagcaggccaagagtaggaacaaagcaagaaaacgttccgtggggagacttgagctgggaattagggtgttggtgcccctagtgaagacctagtgggcatctgtaggccactgccacctctgcttttggccacagtgccactcaggcagtggcctccattcacccaaagactaagtaacttgcccttgattacactggtcttttgtgtccagggccaagtatctgctcaggcctcctgagttctctgcttctcagagccatggcattatctgctcagcaggaggcaagttctccttaaaggactgaggctgacttggttcctgtaggcagccatcaccttgtggtgtctggtgttggttgggggaagtgtttcctttaggtctgaggtaatcagagcatcaggcccacccctcaggcagagggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaa

SEQ ID NO: 751 - DNA, 2645 bp, Homo sapiens
gtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctg

SEQ ID NO: 752 - DNA, 1473 bp, Homo sapiens
aaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctgctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagt

SEQ ID NO: 753 - DNA, 1505 bp, Homo sapiens
atgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctattgcagcctgttcccggggcgcttgcttcctctgcccgttctctatacagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgct

SEQ ID NO: 754 - DNA, 1288 bp, Homo sapiens
gtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaagagacaaggtctcagttcactgttgatttcctctggaagatttctgtgactctcttggagcctctgggccaaagtgcttctccgctctttagtaacctgccttttccgaggtaa

SEQ ID NO: 755 - DNA, 2846 bp, Homo sapiens
ggtcagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 756 - DNA, 1361 bp, Homo sapiens
aaatagtggtgatgtcatgcaggcaagatggcggaaggggaggacgtgggatggtggcggagctggctgcagcagagctaccaagcagtcaaagagaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaa

SEQ ID NO: 757 - DNA, 1467 bp, Homo sapiens
atggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgt

SEQ ID NO: 758 - DNA, 1849 bp, Homo sapiens
aggaaaccaaggcaagctccccctgtcaaagcaccttggcccataagaagaaaagggggagccccagatgtgatgagcgcttccaggcttcaggctcagaaggcgcccccagctctcctgtaactcagaggccagtgtgatgggagttcctccactcagcacacttcccctgtaaacacgcctgtggtgggcaaaagggctttggaacggttgcttgtcttttctctcctgcgtaatttccactttcattcatgataatgtcgaacacgcacaaagctcggctggaacgccgggtcactggctcaaccaaccggtggcgtttgcccaaacagcctttctctggggacctgctctcactttcccagatgtgcaaggctctgagcatagactttgaggaagctttgaggaacccagacaggttatgcatttcacaaatccagaagtttttctttgagaatttcaagaacaaggacatccaaagtggggaagcagatgtgattctcgagtgcctgggcttcaaatgggagctccatcagccccagctttttcagtctgagaccttggccaagctctacctgaaagccctggcgcagggcaccacacaccccctgagggagctggaggagcttctgcgagctcaatcacctaagaagaccaaagaaaaatcccctgcaaagaggatcatcatttccttgaagatcaatgacccactggtcactaaagtcgccttcgccacggccctgaagaacctctacatgagtgaggtggagattaacttggaagacctactgggagtgctggcttccgcccacatcctccagttcagtggcctgtttcaaaggtgcgtggatgtgatgatagccagactcaagccaagcaccatcaagaaattctacgaggccggctgcaagtacaaggaagagcagctcaccaccggctgcgagaagtggctggaaatgaacttggttcctctaggggggacgcagatccacctccacaaaatcccacaggacctgctccacaaagtgctgaagtcccccaggttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttgacagtttccagaagaatctatgggattttccccccactggtctgcataaaagaaaataaaatgacataaaagggagca

SEQ ID NO: 759 - DNA, 1851 bp, Homo sapiens
aggaaaccaaggcaagctccccctgtcaaagcaccttggcccataagaagaaaagggggagccccagatgtgatgagcgcttccaggcttcaggctcagaaggcgcccccagctctcctgtaactcagaggccagtgtgatgggagttcctccactcagcacacttcccctgtaaacacgcctgtggtgggcaaaagggctttggaacggttgcttgtcttttctctcctgcgtaatttccactttcattcatgataatgtcgaacacgcagcacaaagctcggctggaacgccgggtcactggctcaaccaaccggtggcgtttgcccaaacagcctttctctggggacctgctctcactttcccagatgtgcaaggctctgagcatagactttgaggaagctttgaggaacccagacaggttatgcatttcacaaatccagaagtttttctttgagaatttcaagaacaaggacatccaaagtggggaagcagatgtgattctcgagtgcctgggcttcaaatgggagctccatcagccccagctttttcagtctgagaccttggccaagctctacctgaaagccctggcgcagggcaccacacaccccctgagggagctggaggagcttctgcgagctcaatcacctaagaagaccaaagaaaaatcccctgcaaagaggatcatcatttccttgaagatcaatgacccactggtcactaaagtcgccttcgccacggccctgaagaacctctacatgagtgaggtggagattaacttggaagacctactgggagtgctggcttccgcccacatcctccagttcagtggcctgtttcaaaggtgcgtggatgtgatgatagccagactcaagccaagcaccatcaagaaattctacgaggccggctgcaagtacaaggaagagcagctcaccaccggctgcgagaagtggctggaaatgaacttggttcctctaggggggacgcagatccacctccacaaaatcccacaggacctgctccacaaagtgctgaagtcccccaggttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttgacagtttccagaagaatctatgggattttccccccactggtctgcataaaagaaaataaaatgacataaaagggagc

SEQ ID NO: 760 - DNA, 3044 bp, Homo sapiens
aatgtttccttaaaagtgttaacttgaagattatacctgtggagctgggatgtggtgctcaggaagaatataagtagtcagcattgtagcagttgagtctcagtggtaatggaaatgaggaaggttgaaggataataatagttaccatttggggcttggtagttattttgtgccaggcactcactgtgctaagcaactttaccttcactgactcatttaatctttaaaacaaccctacaaggagtctgatctgtgaaaacctagaaggtttgttaagactcttgccaacatgtgctctcctgccagtcccaaaatcctatacaggaacccccggttcctcaggttagcttttctgcagcttcatcaccagcagcagagtgatgtgttctgtgatgtccttctgcaggcagaaggtgaggcagttccagctcactgctgcatcctgtcagcttgtagccccttcttcacagagcgcctggagcgggagaggccagctcagggtgggaaggtggtgctagagctgggtggcctgaagatcagcacacttaggaagctggtggacttcttgtatacctcagaaatggaagtatctcaagaagaagcccaggatgtgctatctgctgcccgtcagctccgtgtgtctgagctggaatcccttcagcttgagggtggaaagttggtgaaggccccacagggccgaaggctgaaccgagagtgcttacaaccaacaagtgctgcaccaatctctgccagagtggtgacacccagccaccaccctcacaccccactgcccactaatcaaactccttgtcctcttggggcaataagattgaagtccttggggaaggaagaggggccccaggaaaacaaccgacagaatgcagacaatttgtctggcactcttctgctcaagaggaaggccagagcctgcccaactccacaagaaaaaaactcttcaccatcaagccatagtcaagagcctagagagaacaagaatgacactgcccttgatcctacagtgctctccccacccagcttgtacccctctgtggacaaacacctgttgcccagaaagatcaggctcagtcgctcaaagccatctcctggtatctgtacatcaaagccttccagcattttaagtggatctagctcagtgcctgcaacccctggccggcgtctttggcggcagaggagtgtaaataaagaaacaccagaggacaagccaaaaccaggcagagctagtcctctgcagagcaccccaaacccatctggtctgggaaagacaggtgggagcaggaagcggagccctgaagtcagggcacctaactcagactctgcagaggaggggcaggttgggagagttaaacttaggaagattgtcaatgggacttgctgggaagtggtacaagagactcctctcaaaaacactcaagatagcccccagatcccagatcccggaggagacttccaagagccttcaggaactcagccattctccagtaatgagcaggaaatgtcacctactagaacagaactgtgtcaggactcccccatgtgcactaagctacaagacattctggtctctgctagccactccccagaccacccagtggtgaagtcagagtttgagtccagtccagaactggtagagaaggaacctatgttggctattgactgcagagaaccctatgcatttgacacagctctgctggagcagccctgtgaggctgaggagtaccgaatcacaagtgctgctgccaccagtgagctggaggagatcctggacttcatgctctgtggctcagacattgaaccacctatagggtctctggagagtccaggggctgagggctgcagaacgcctacctaccatctgacagaaacaggaaagaactggattgaaggggaagaatggtgtctaccagacatggaactctggcccagggagctcacagaattggaaaaggaacctgctggtgagaacagagggccaactgagctccttagcccccttgtcatgccctctgaggtgagtgaagtgctttcagtaggaggccgttggacaccagaccttgaaattaccagctcccagccactggatggtcaggaagacaaacttctccatgtcagctcccttgatactccccagaggtcttatggggacctctcacctccctgctcaaactgggtggagactgggctggaagtctccttgactacagatgagttattatacccttctcccaaggcaggcaaggaggtatctggtcactctgaactactaggctcacttcctgccagctctgaagaggaagagattgatgtggtggactggacagcagaggggaggctggtacccactactgttccctccgtgtggcctgacccttcctcagagtcagaaacagaggtagatatactaacatagtggagaggggagggcaggttaggggccttgggagggtgggaaatgttagctagcaaaaggcttactggcagagaagctggcacgtgccctcagcacaagaggcaggtgtaccctggctctttgtaggtcccttcctcccttccctaagcctcagaagccaggcagaagccaagggtaccatagatagaaaattatgaacttgtaccatcttatttgtaatctattttccggttagtgacaactgaaacaaactgtgtgctccccaattctggtgggtcataggtaacagccaaggccagatctctcaggtcataaggcatccagtcactggtaatttaggaaaagctgagaaagaacaccctcctctgtggtggggtattgtttaagaaaatgttccagaggaaggtgtgaagcagtgttgggtggaatactaagtgggtgggagtgatggatgctgtccagcacccaacgtggggcttattcactgccagtattaggaagtctagctaaaacctctgcaggggccaagaagatgtacttccatcattacttccaaaaagtaagttgaaaaagatacagttgcttttttaaaaaataaattatttactttgctccc

SEQ ID NO: 761 - DNA, 2583 bp, Homo sapiens
atatccttggcacaatttctgggctgatgtttcctcaactcatactattatctctcactttcaaaattcccctgccatttcaaagacaaaaaacaaattagatgtaaccatgcctctgaaatgtattatctcacctacaggagtctgatctgtgaaaacctagaaggtttgttaagactcttgccaacatgtgctctcctgccagtcccaaaatcctatacaggaacccccggttcctcaggttagcttttctgcagcttcatcaccagcagcagagtgatgtgttctgtgatgtccttctgcaggcagaaggtgaggcagttccagctcactgctgcatcctgtcagcttgtagccccttcttcacagagcgcctggagcgggagaggccagctcagggtgggaaggtggtgctagagctgggtggcctgaagatcagcacacttaggaagctggtggacttcttgtatacctcagaaatggaagtatctcaagaagaagcccaggatgtgctatctgctgcccgtcagctccgtgtgtctgagctggaatcccttcagcttgagggtggaaagttggtgaaggccccacagggccgaaggctgaaccgagagtgcttacaaccaacaagtgctgcaccaatctctgccagagtggtgacacccagccaccaccctcacaccccactgcccactaatcaaactccttgtcctcttggggcaataagattgaagtccttggggaaggaagaggggccccaggaaaacaaccgacagaatgcagacaatttgtctggcactcttctgctcaagaggaaggccagagcctgcccaactccacaagaaaaaaactcttcaccatcaagccatagtcaagagcctagagagaacaagaatgacactgcccttgatcctacagtgctctccccacccagcttgtacccctctgtggacaaacacctgttgcccagaaagatcaggctcagtcgctcaaagccatctcctggtatctgtacatcaaagccttccagcattttaagtggatctagctcagtgcctgcaacccctggccggcgtctttggcggcagaggagtgtaaataaagaaacaccagaggacaagccaaaaccaggcagagctagtcctctgcagagcaccccaaacccatctggtctgggaaagacaggtgggagcaggaagcggagccctgaagtcagggcacctaactcagactctgcagaggaggggcaggttgggagagttaaacttaggaagattgtcaatgggacttgctgggaagtggtacaagagactcctctcaaaaacactcaagatagcccccagatcccagatcccggaggagacttccaagagccttcaggaactcagccattctccagtaatgagcaggaaatgtcacctactagaacagaactgtgtcaggactcccccatgtgcactaagctacaagacattctggtctctgctagccactccccagaccacccagtggtgaagtcagagtttgagtccagtccagaactggtagagaaggaacctatgttggctattgactgcagagaaccctatgcatttgacacagctctgctggagcagccctgtgaggctgaggagtaccgaatcacaagtgctgctgccaccagtgagctggaggagatcctggacttcatgctctgtggctcagacattgaaccacctatagggtctctggagagtccaggggctgagggctgcagaacgcctacctaccatctgacagaaacaggaaagaactggattgaaggggaagaatggtgtctaccagacatggaactctggcccagggagctcacagaattggaaaaggaacctgctggtgagaacagagggccaactgagctccttagcccccttgtcatgccctctgaggtgagtgaagtgctttcagtaggaggccgttggacaccagaccttgaaattaccagctcccagccactggatggtcaggaagacaaacttctccatgtcagctcccttgatactccccagaggtcttatggggacctctcacctccctgctcaaactgggtggagactgggctggaagtctccttgactacagatgagttattatacccttctcccaaggcaggcaaggaggtatctggtcactctgaactactaggctcacttcctgccagctctgaagaggaagagattgatgtggtggactggacagcagaggggaggctggtacccactactgttccctccgtgtggcctgacccttcctcagagtcagaaacagaggtagatatactaacatagtggagaggggagggcaggttaggggccttgggagggtgggaaatgttagctagcaaaaggcttactggcagagaagctggcacgtgccctcagcacaagaggcaggtgtaccctggctctttgtaggtcccttcctcccttccctaagcctcagaagccaggcagaagccaagggtaccatagatagaaaattatgaacttgtaccatcttatttgtaatctattttccggttagtgacaactgaaacaaactgtg

SEQ ID NO: 762 - DNA, 557 bp, Homo sapiens
aatgtttccttaaaagtgttaacttgaagattatacctgtggagctgggatgtggtgctcaggaagaatataagtagtcagcattgtagcagttgagtctcagtggtaatggaaatgaggaaggttgaaggataataatagttaccatttggggcttggtagttattttgtgccaggcactcactgtgctaagcaactttaccttcactgactcatttaatctttaaaacaaccctacaaggagtctgatctgtgaaaacctagaaggtttgttaagactcttgccaacatgtgctctcctgccagtcccaaaatcctatacaggaacccccggttcctcaggttagcttttctgcagcttcatcaccagcagcagagtgatgtgttctgtgatgtccttctgcaggcagaaggtgaggcagttccagctcactgctgcatcctgtcagcttgtagccccttcttcacagagcgcctggagcgggagaggccagctcagggtgggaaggtggtgctagagctgggtggcctgaagatcagcacacttaggaagctgg

SEQ ID NO: 763 - DNA, 1572 bp, Homo sapiens
aggcttcccaccccgtcggctgcctgggcagactcccagccagggcctctttcgccgccgccgccgccgccagccagccagcttcttcccaggaccataggccactccagcctcagcttctcctggccccctccctgtgtctgttcctgtccccgagcctctggcctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactcatggagcccttgggactggtcgtgcatgggaaagctgaacctttttccgcagcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagctgtgcctgcagtttgtggtgaaggtgctggatgtggacttggtttgtgaggccctgcaggtggccgtaacctttggcctggggcagctgcaggagcgctgcgtggctttcatagaggcccacagccaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggcggtgctggagcggccggtggctgaggtggcggccccggtggtgaaagagctgagactagccttgctggccccggcggagctgagcgccctggaagagcagaaccggcaggaaccactcatcccggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctc

SEQ ID NO: 764 - DNA, 1637 bp, Homo sapiens
aggcttcccaccccgtcggctgcctgggcagactcccagccagggcctctttcgccgccgccgccgccgccagccagccagcttcttcccaggaccataggccactccagcctcagcttctcctggccccctccctgtgtctgttcctgtccccgagcctctggcctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactcatggagcccttgggactggtcgtgcatgggaaagctgaacctttttccgcagcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagctgtgcctgcagtttgtggtgaaggtgctggatgtggacttggtttgtgaggccctgcagcacttttggaggccgaggcgggcggatcaagaggtcaggagatcgagaccatcctggctaacacggtggccgtaacctttggcctggggcagctgcaggagcgctgcgtggctttcatagaggcccacagccaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggcggtgctggagcggccggtggctgaggtggcggccccggtggtgaaagagctgagactagccttgctggccccggcggagctgagcgccctggaagagcagaaccggcaggaaccactcatcccggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctc

SEQ ID NO: 765 - DNA, 4686 bp, Homo sapiens
attgcgcatgccccgtatccaaggccgcctccgggagcacctcccatgccgctccgctccctcccggtgaccgggcacgcgcgctcgctcccgcagagcgtgccctgcgtgcgggtgcccgccgagcccgccgggcgctggatctccgagtgccccggccggggcctgaggagcgggcacagggcaaggcggcggacggctgcgtcgcccgaggcgaggaggagcgctggcgagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcatagatttgttttccttta

SEQ ID NO: 766 - DNA, 4857 bp, Homo sapiens
cagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 767 - DNA, 4826 bp, Homo sapiens
agagcgtgccctgcgtgcgggtgcccgccgagcccgccgggcgctggatctccgagtgccccggccggggcctgaggagcgggcacagggcaaggcggcggacggctgcgtcgcccgaggcgaggaggagcgctggcggtgtcactgttttgcttggtccaatcatgattggtgacttcagctattggctcggagcactggctgtctgactccatctgcagggctgtaatacctactctcctccgatccattcaccacacaacttcagccggctgaacagactcacgcagctccagcccatcttgctgacctaattcagaaaagaagtgctacagctctgtgcctgtcatctttgcagtgtagcattttcagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcatagatttgttttccttta

SEQ ID NO: 768 - DNA, 5137 bp, Homo sapiens
tgcgtgcgggtgcccgccgagcccgccgggcgctggatctccgagtgccccggccggggcctgaggagcgggcacagggcaaggcggcggacggctgcgtcgcccgaggcgaggaggagcgctggcggtgtcactgttttgcttggtccaatcatgattggtgacttcagctattggctcggagcactggctgtctgactccatctgcagggctgtaatacctactctcctccgatccattcaccacacaacttcagccggctgaacagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcatagatttgttttccttta

SEQ ID NO: 769 - DNA, 583 bp, Homo sapiens
cttttcggaagaatttttgaatcaccctttttcatttcttggcctcagcagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacact

SEQ ID NO: 770 - DNA, 485 bp, Homo sapiens
ggaggtggcggaggtccaggcagggggcgcggtcgggaagcctcggcgcctagcaggtggcgggggccgcgcccctctcccggggaggcgcgcggtgggaagcggagcaaacttcccctaagtgtcactgttttgcttggtccaatcatgattggtgacttcagctattggctcggagcactggctgtctgactccatctgcagggctgtaatacctactctcctccgatccattcaccacacaacttcagccggctgaacagactcacgcagctccagcccatcttgctgacctaattcagaaaagaagtgctacagctctgtgcctgtcatctttgcagtgtagcattttcagagacggtaaagaacaggtccaagaaaagctcaaagaaagcaaataccagcagcagcagtagcaacagcagcaagttgccaccagtttgttatgaaataattaccttgaagactaaaaagaagaagatggc

SEQ ID NO: 771 - DNA, 2196 bp, Homo sapiens
cgtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaagggaatgcggattgtggatgatgatgtgagctggacagctatctccacaaccaaactagaaaaggaggaagaggaagatgatggagatttgcctgtggtggcagagtttgtggatgagcggccagaagaggtaaagcagatggaggcctttcgttccagtgccaaatggaagcttctgggaggccacaacgaagacctaccctcaaacagacattttcgtcacgataccccggattcatctcctaggagggtccgtcatggtaccccagatccatctcctaggaaggaccgtcatgacaccccggatccatctcctaggagggcccgtcatgacaccccggatccttctcccctcagaggggctcgtcatgactcagacacatctcctcccaggaggatccgtcatgactcctcagacacttcacccccaaggagggcccgtcatgattctccagatccttctcccccaaggaggcctcagcataattcttcaggtgcatctcctaggagagtccgtcatgattcaccagatccctctcctcctaggcgagcccgtcatggttcctcagatatctcttcccccagaagggtccataacaactcccctgacacatctaggaggactcttggctcttcagacacacagcaactcagaagggcccgtcatgactcccctgatttggctcctaatgtcacttattccctgcccagaaccaaaagtggtaaagccccagaaagagcctctagcaagacttctccacattggaaggagtcaggagcctcccatttgtcattcccaaagaacagcaaatatgagtatgaccctgacatctctcctccacgaaaaaagcaagcaaaatcccattttggagacaagaagcagcttgattccaaaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggctgcacacatgtattctggggctaaaactgggttggtgttaactgacatacagcgagaacagcaggagctcaaggaacaggatcaagaaaccatggcatttgaagctgaatttcaatatgctgaaaccgtatttcgagataagtctggtcgtaagaggaatttgaaactcgaacgtttagagcaaaggaggaaagcagaaaaggactcagagagagatgagctgtatgcccagtggggaaaagggcttgcccagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtatttatttttttaaaatta

SEQ ID NO: 772 - DNA, 1793 bp, Homo sapiens
gtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaagggaatgcggattgtggatgatgatgtgagctggacagctatctccacaaccaaactagaaaaggaggaagaggaagatgatggagatttgcctgtggtggcagagtttgtggatgagcggccagaagaggtaaagcagatggaggcctttcgttccagtgccaaatggaagcttctgggaggccacaacgaagacctaccctcaaacagacattttcgtcacgataccccggattcatctcctaggagggtccgtcatggtaccccagatccatctcctaggaaggaccgtcatgacaccccggatccatctcctaggagggcccgtcatgacaccccggatccttctcccctcagaggggctcgtcatgactcagacacatctcctcccaggaggatccgtcatgactcctcagacacttcacccccaaggagggcccgtcatgattctccagatccttctcccccaaggaggcctcagcataattcttcaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggctgcacacatgtattctggggctaaaactgggttggtgttaactgacatacagcgagaacagcaggagctcaaggaacaggatcaagaaaccatggcatttgaagctgaatttcaatatgctgaaaccgtatttcgagataagtctggtcgtaagaggaatttgaaactcgaacgtttagagcaaaggaggaaagcagaaaaggactcagagagagatgagctgtatgcccagtggggaaaagggcttgcccagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtatttatttttttaaaatta

SEQ ID NO: 773 - DNA, 1688 bp, Homo sapiens
agcctgacagacgctccaggtcgtctagcaagccgccctcccccgccgccagcaagaaggtggcgtctcgcagctcctcgttattcgtccgcctcgggtccatccggccccgccgcccgactttgcgctgagacccaaggggaagccccgaggggaccccgcgccgtaggagggagtggaggagccggcgaaccgcgatggagccggggcccagcacagcgcgagcggctcctcggctgttcgtgctgcttccccagcttcttcaccggcacctgcagcttccgcacctcctggtccgcgttcacgttagagttaacgtcctccatcccggccccgctgcctccgccgcccgcggccctctcgctctcgcagcaacaagggaagagccggaggaaagaggcgtccacgccgctcactccagccgaggcccccgcatatagcagggccaggccccgtcgccagggttcccccagcgcgggtcccgaagcaccgctggccacagatgaaccgcctcctcagcgcaggtccgggattcggggaggcagcgccaatatccggtctctgcagccatcttccctccgtccctccgcccaccgagggtcggccctgtaggtgacctcagagcgtcggggatgggcgtggccccgtcgggcgctaagaagacctagcgcagagaggaccgccgagctcccgacggggcggggccaggtgtgtgaggggcggggattggacccggaggggcgtgtctggactgccggcggaagtggaacgcggcctgacctgcgacggaaagccactgcaagcccggaggcgaacagaaggcattccgcgagccgggctgagttggtgaacacggtcctcgttcaccccgcctattggtctgggcgtgtggggtattctccacccacttatacggcgtgtgggaccgacgggcccgtcctgcccggctccggtccggatctcgagtaggcgctcaatgggattcggggagacgtagtttactttgttcagcaaatatttaaccgatgcctattttaatgggagattgtttccgctggcgggagcctcagagaccgcctgtgtcctttaagaaacccgaatttcagacagttaagagaggtctaaggtcaaaataataatcataatttcttcttactggccagatactatgctaagccctttttaattttattattattatattttgtcaccgaggctggagtgcaatggcccgatcttggctctgcaacctccgcctcccggtttaaagcgattctcctgcctcagcctcccgagtaactgggattacaggcgggcgccaccacgcctcgctgatttttgtattttagtagagacggggtttcgccattttggccaggctggtctcgaccctgacctcagggtgatccgctcacctcagccactcaaaagtgctgggattactggcgtcagccaccgcgcgcccggtcgtgctaatcactttgaaaggcattatctcatcggttaaaacatagttttccggacttaaaagtttacagcacactggcgcagaagatggaaaaccgctgcttgcctttctccgtttattgactcacattctgctctttggatcattttcttcggaaaaagttttccaaagtgtgtcttgtgtattaaaagttgtgtattaaaagtatttgaacacgctg

SEQ ID NO: 774 - DNA, 2439 bp, Homo sapiens
agcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtggccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgaga

SEQ ID NO: 775 - DNA, 1708 bp, Homo sapiens
gggccccacccagcctggctgaggggcggtggagagtgtccgcctggacggtgaggtcagctggcggctgctggccaccctcgtgctcgaaagatgcccctagcgccccctccgttgcatcaggaccctaggccagcctgtcccagtgtctcctcagctcaccatggcaggctcaatggtgaccccccttttatataggaggaaactgaggcctggcgaaagaaagatgcggcctgaggtgggacgtgaacccgcggccctgcagcccagacagcggccccggagtgaccaccagcttcaccgaagcccctttactgtgcccccgaggacacctgcctgccgttccccagggccgtcaccgccgatagcggtagcgcttgaagtgaaaccacagctggaagatgccgttggcaaactggcagcggaagccgtggcggtgcgagtattcccactcgcggttgacgatcttgaaagcgatgtcctcgtagggcggccccgcgtggaagcgcaggatggcgaaatccttgttgtcggcgcaggcctccaggaagtactcgggcgtggagcgcttgtcgatgaggtcggggtagaagatgttgaacttgtatccctgcacgatcttgggcggtgggttgtcaaagtcgtagtgcgtctggttgtacttgttccactcgaagcccgtgtgcacgcggttgaagaagcgcggcttgcgtggccggtacttgtcggcccacaggtaggccttgccggtgagtggcatctccacgctgaactgcgcctcgtcctggcccatgccctccttggcccgccggaagaagatgtcctcggcgctctcgctggcgtctcccgtgacctggagctgctggcgcgagagctgcaggcgctgcaggtcctcatccggttccagcacgtgcgcgtccagtggcagctcgtgcgccgtgagcagccgcgggctgtacctgccggcgtcgtagtcgtccaggctctgctggatcaggtcctcctccatgagcaccgcctcgccctcgccctcgccctcaccgtccccgtcgccgtcgccctctgtcggggtcgcgccgtccacctcggcctccgcggggccgccctccgaggagggcccgggcggggtgggcgccgcgtcctcaggctccaggctgcggctgggggactggggctcctgcttgaggatggggaacagcggctcgctctccacgccctgctcctgcttcagtttgtacagcttctgccgcagcacgtcctggtggcgctcacgcagcctagtgctcaccgggcccgtgccatgtgggcacgaagctgctgcaggaggctctcccagtagcccatgtccaggttggggccaccagcgcggattttgccctcgatgccctggaagatgacctgcagctggttgtatgtcttccccttgaacaccgactgcacatcagagctgacggaggcgttgaccccctcgcggcgctcacctggccccttgcccgaggcctccagcttgcggagcttggagatctcgtcctcggtgatggtggtcatgtcccgccagaagtcggcgttcttgccctgctccagctccatgtagacctggatatcctccagcaggtcctccatgtcggccacggtgaggccgttgaggaacgtgtagggctcatgcatctccacggccagatcgtcatcctcagcgctgatgtacttg

SEQ ID NO: 776 - DNA, 1757 bp, Homo sapiens
agaataatgcagacaactgatcactgcaagtcactctgccttggagctattggaatggctccagaacagggcactgggggccaaggcaggatttcaaccaggagggttttacagaagatggacttcacctgtgagggctggggttggaaccgagcaccaaagaagtggccactgtccactgatggccgtctccctcttctctgtagccctcccccacccctaagcagcccagcttcagcagaggaggcctgggcacaggaatggattgttgctagaaacctggcttcagctggaggaagtcagaagaccgggctgatggccgcgcagacagagctgtgtttatccaggaaaagagccccccagactgcgccgccctttctttttctgctcaaataggggtccgcgctcccagtgggtccggagaccggggcgcggtggctgaccgcccggtgtacgccagcatcactcacctctgactcctctgcgctcctcgcccagccccgctccgccgagcactcccatctgagacgggatttggaccctctcggccctgcggaattcggaattccattaccccacccaccgcatgtggctcttggaaaaagctggctataaggtgggggccgcggagcctgcggcccgttgggcgccttccggcctgttctccaagcgtcgcgccccgggcccgcccacaagcgcctgccccaacgtcctcaccccggatcgcatcccgcagttcttcatcccgcctcggctcccggacccgggcggcgcagtgcccgcggcccggcggcacgtggcggggcgcggcctccccgcgacctgctcgctgcctcacctggcgggccgcgaaggctgggccttcctgcccgagagcccgcacacgcgccggcgggaatccctgttccacgggccgccacctgccccggccgggggactccccgcggcgcagtcccggctgcacgtctccgccccggacctgcgcctctgccgggcccccgacagcgacacggcctcgtcgccggactcgtcgcccttcggctccccgcggccaggcctgggccggcgccgggtgtccaggcctcactctctgtccccagaaaaagcgagctcggccgataccagcccgcactcgccgcgccgcgccgggccgcccacgccgccgctcttccacctggacttcctgtgctgccagctgcggcccacgcgcgagagcgtgctgcgcctggggccccgcggcgggcagctgcggctctccaccgaatatcaggccgggcccgggcggctgcggctgcgcctagtgagcgccgagggcctgccccggccgcggtcccgccccgggagcggcggcggcggctgctgtgtggtgctgaggctgcggccccgcgtccggccgcgggagcagcagagccgcgtggtcaagtgcagcgccaaccccatcttcaacgaggatttctttttcgacgggctcggccccccggacctggccgcccgcagcctgagagccaaggtgctagacaggggcgcgggacttcgcagggatgtgctgctgggggagtgcgagacgcccctcattgcgctgctgcccccgctgggtgggggactaggtcccgggtcatccctggcgcccacccatctcagcctgtagcctgagcccctggcttcctcaggacgtctccactgtgtctgcagtccacattctttccaccctgcccggcttgtatttatttttgctaataaaatgtccccttgtcctt

SEQ ID NO: 777 - DNA, 4769 bp, Homo sapiens
gagccggtgccggcccgcgagccccagcgtctctgcagaccagtcccctccagggtccggcggggcccgcgcggtgggaggagtcgggcactggccggcgactaacgggtccgactgctgaccaagctaggagagacccggaccacggagacagagaccccggcatcgcgacccccgaggacctcctctcctcgccctgtggcacccactagtcctgggcactcagccgcggagagcccccgaccccgcgcgcccagccccgggggagcccacctcctccccgcggcccgcccgggccatgctcccccggggcagcgggtgagccccagccgggaccgggatcggagcccgcgcggagcatggatccgggctgggggcagcgggacgtgggctgggcggccttgctgatcctcttcgccgcctcgctgctcacggtgttcgcctggctgctgcaatatgcccggggcttgtggctggcgcgggcccgcggggaccggggcccgggacccgccttagccggggaacccgcgggttccctgcgggagctgggcgtgtggcgctcgctgctgcggctgcgggcgactcgggctggcgccgccgaggagccaggagtccggggcctcctggcgtcactcttcgccttcaagtctttccgggagaactggcagcgggcttgggtgcgagcgctgaacgagcaggcctgcagaaacgggagctccatccaaatcgcctttgaggaggtgccccaactcccacccagagccagcatcagtcatgtgacctgcgtagaccaatctgagcataccatggtgctgcgttgccagctctctgctgaggaggtgcggttcccagtctctgtgacccagcagtcccccgctgccgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagcccaggggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaactggacaactggttatcctttgaaaggcagtaggcagccaggctgtgacatggatggtgtgggaggatgagacaggggcccggataatgaggttgggtagatgacacacattgtggatctgctaagaagttcctgcagggaagaaggggtgtgcagagaaaggatggaagagacaggaggctctggagtatgaaattgtagcaaaaaactcaatcaactagtacaggttagtcttcattcccctttctggaacaggctgctccttctaggatgtaatggagatcaaagcttggaccctgtaactagactgcctgcctgggtttgagtcccagctcttctaattacttgtgtgaccttgggcaagttatgtaacctctaagtgcctcagttttctcatctgtaaaatgggaacttcaatcatcatggctatcatttggttgtggatgagaagtaaatgaagtgctgagtgttaactgttgcctcagaagaaactgggagggggaagtcttagaagtgtttcaacataataaaagctctctcattctgaaatgtgggcaaatttcagggattgatagatcctagcaaactgtgtccctggttcccgtgcttgagatcttatacaggacttgaaccaggtaagctgctacaggatattgggcagaatgcaggaccaggaagcaagaaaactgagtctgccacagacaaaccaagtgatcttgagcaggcaacttctcctttggggacctcagtttcctcatatctaaaataagggtgacctggataaacattcaggtcacttccagccttgacattctatgactacctatatctcagggtgtttagggcacatgcctttgggtagatagcatgtggaaattgttactattccccatgctcctgtccacactactcaccaaatatgagatatccgggaagaatggagggtatagattttttttttcaattagataatttagttttatatatttggggggacaagtgcaggtttcttacatgcatatattgcatgcatagaggtgaagtctgggctttttttagtgtgcgcatcgcccaaatagtgaacatcatacccaataggtagtttttcaaccctcaccctcctcccaccttctcacctttcatagtctccgatgtcttttattccactctatatgtccatgtatacccattatttagctcccacttataaatgagaatatgccatatttgactttgtttctgagttatttcaccgaggataatggcctccagttccacccatgttgctggaaaacacatgatttcattcttttttatggctgagtagtattccactgtgtgtgtgtgtgttgggcgatgataatgatgtccattgctgtgtgacagcttggaatttaatttattaaagtcaagttggagtt

SEQ ID NO: 778 - DNA, 5856 bp, Homo sapiens
aaaaccaggaggggaagctgagtggcttctggaataaactttgggtgtgagacgggattcaggctgtggctaatgtgctggaagcacgcacagttgtgaccatcaagtatgcaggaagcaatcattctcctggctctcctgggtgccatgtcagggggagaagcactacacctaatcctcttacctgctacaggcaatgtggcagagaattctccacctgggacttcagtgcacaagttttctgtgaagttatcagcatcattgtcacctgtgatcccaggatttccccagatagtcaactcaaatcccctcactgaagcttttagggtgaattggctgtcaggcacctactttgaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaaggtctacacctctacatagtagaaagagcaaaccctggattcatttaccaggttgaggccttcgatccagaagacacaagccgaaacattcccctcagttatttcctgatttctcccccaaagagcttcagaatgtctgctaatggcaccctcttctccacaacagaattggactttgaagcaggacacagaagtttccatctcatcgtggaggtgagggacagtggaggcctcaaagcctccacagagctccaggtgaacatcgtgaacctcaacgacgaagtccctcgctttaccagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacgaaaatccaagtaacctagcagccggcaataaatatacggtgataatccaggtgcaggatgtggcccccccttactataaaagcaaatataacgtctacgtttatatcctaacaagcccagaaaatgagtttcctctcatttttgataggccatcctatgtatttgatgtgtcagaaagaaggcccgcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgtaagggaaataccaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacactatgaactttcttgtacatgtcttttggtgaacataaacactcacttttttgctcatatatctaagagtgggattgctggagcaattgctggatctgccaaagagttccaaagtggtggctctgattcacattccagcagcaaacactgagagttgcaattgctctctatccttgccaacacttgggattgtcaatccttttaactttagccattctggttaaaattactattgaagtgaaatcactttttcctcaaagctgaaacaccatcagccttacaacctacctgccttgctccttcccacttcctatgattggaaggaactgcaggactctgagtggggacatactggaagccccatctagacataaaactcagacttccacctgtaggcatgagcaatgaactgggaataaatggtattatgatggaataggaaatgtaactttccaatgtgtgcctagcagagcctgagcaagcttcactcgagctctatgccctgctgcccagctgctgcgaccctagtccagtaaccctaagaaaggtccaggtgagtgttcattagggaagcactcccttcccaactggggagtcaggtgagagcctaccaggtccacaaggtcctgtgggagacagactggatccagcaaatgtagagcttcagagagagcagcagcttgtttactgtgtgcctagtgccagtgtcacttctcaagcaaaagaagcatttgcaaaatgcctgtcctggcctagattgagcgtgatttattaataagggttggttgccagggaactcccttgaatggatttaaactttgcaaaagaaggcagaactgttcatttatgcaggttaaagtgagtgaagtggctgattgcccatttaaggcattgcaaatctgtggggcccggagtcaaatgctttccttggaagctctcagcttcaatgcaagtaaaatgaggttctgagaaggctgaagggggacttaataactgcttataagcccattaagaatgattaaaagggccgggtgaggtggctcatgcctgtaatcccagcactctgggaggctgaggcaggtggatcacctgaggtcaggagtttgagaccagcctggccaacatggtgaaaccctgtctctactaaaaaatagaaaaattagctggacgtgttagcaggcacctgtaatcccagctactcaggaggctgaggcaagagaatcgcttgaacccaggaggcagaagttgcagtgggctgagattgcgccactgcactccagcctgggtgacaagggcaaaactctgtgtcaagaaaaaaaaaaaaaaaagaataattaaaaggagagagtggtgagcagctggtctttcttctccagtgatgacagggcaagagggaattgtgcttaatggccagagaagagatttaagtcaggcaccaagagggacttcctgaagcctggggcctctctgaagagctcagtgtcttctctggtgataggcaggaagagctgagtgtcttcctagtcgcaaggcaagcctcgagaaactcaagaaataggggcaagagtgcgccaggaggagagaacacctgctgccccgtttcttttgtatatccggctatttggttcggggaaatccagaagtcaaagtgtcaccggtggagggtcttgactgcaagttgtccaagttcttggagttttgaacaaagaatggaacaaaatgcccagcaaagcagagaaagaatgaggcaacgaaagaatgaaagcagggatttattgaaaaccaaagtacactccacagtgtgggaacgggcctgagcaagtgactcaagggcccagatacagtcttctcagtccaaataccccttggaggtttccccttggccacttcatgctcacctcatggaaatgaagtagtggaccacaattggtctgattggttgcaggaagcaaccaatcagagactgaagtggagttacaaaggtcacgctcctgtgcaaacatctgattggttgcaaaaagcaaccaatcagaggctaaggtgaagttacaacgttgcaacgaagactcggctggcaatcagtctgattggttacagacagccaatttcccagcgttgaccaggttttggggggaacaaaattatctgaataaaatgaagacagcaaccgtcgtggatttggtgaaagttttctcccatctccctctcaaggccttaaacaggtatgagttgattatagccaatgtttacttttctcattctgattcattataaaactggggtaaatacgttcaggaattagaccacgtaacaattataattgtcgaagactttgaaactgcatagtagattgtgacattggagctttttgttgtgctcattagaaagcagggtctgaaactcagcctgtgtagcaagcacgggtggctcacaagcagaactgggaaatgacacttctgctccccagagccccctttcacatctggggttctcattgtttgcctttttacttaatgtattttgtaatggctgtgaaaattaagctacaaaatgagtgaacattgaagacaatgattgctattgaaacttaggatttctcatttcaaacttagcgtgtgtttatccttcgtattcattcaataaatatctgtggagcaacta

SEQ ID NO: 779 - DNA, 2358 bp, Homo sapiens
tacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacgaaaatccaagtaacctagcagccggcaataaatatacggtgataatccaggtgcaggatgtggcccccccttactataaaaataacgtctacgtttatatcctaacaagcccagaaaatgagtttcctctcatttttgataggccatcctatgtatttgatgtgtcagaaagaaggcccgcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgacaaagaaaggagaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacacta

SEQ ID NO: 780 - DNA, 971 bp, Homo sapiens
acgcacagttgtgaccatcaagtatgcaggaagcaatcattctcctggctctcctgggtgccatgtcagggggagaagcactacacctaatcctcttacctgctacaggcaatgtggcagagaattctccacctgggacttcagtgcacaagttttctgtgaagttatcagcatcattgtcacctgtgatcccaggatttccccagatagtcaactcaaatcccctcactgaagcttttagggtgaattggctgtcaggcacctactttgaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacg

SEQ ID NO: 781 - DNA, 6500 bp, Homo sapiens
aaaaccaggaggggaagctgagtggcttctggaataaactttgggtgtgagacgggattcaggctgtggctaatgtgctggaagcacgcacagttgtgaccatcaagtatgcaggaagcaatcattctcctggctctcctgggtgccatgtcagggggagaagcactacacctaatcctcttacctgctacaggcaatgtggcagagaattctccacctgggacttcagtgcacaagttttctgtgaagttatcagcatcattgtcacctgtgatcccaggatttccccagatagtcaactcaaatcccctcactgaagcttttagggtgaattggctgtcaggcacctactttgaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaaggtctacacctctacatagtagaaagagcaaaccctggattcatttaccaggttgaggccttcgatccagaagacacaagccgaaacattcccctcagttatttcctgatttctcccccaaagagcttcagaatgtctgctaatggcaccctcttctccacaacagaattggactttgaagcaggacacagaagtttccatctcatcgtggaggtgagggacagtggaggcctcaaagcctccacagagctccaggtgaacatcgtgaacctcaacgacgaagtccctcgctttaccagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacgaaaatccaagtaacctagcagccggcaataaatatacggtgataatccaggtgcaggatgtggcccccccttactataaaaataacgtctacgtttatatcctaacaagcccagaaaatgagtttcctctcatttttgataggccatcctatgtatttgatgtgtcagaaagaaggcccgccagaacccgagtgggacaggtgcgagccactgataaagacctcccccagagcagcctcctgtactccatctccactggaggggccagcctccagtatccaaatgtattttggattaatcccaagacaggagaactccagctggtaactaaagtggactgtgaaacaacccccatctatattctcagaatccaggccaccaacaacgaagacacaagctctgtcactgttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtaacgtcaacaatcatttcaccttctctcccaatgctggttccaatgtcacacgcctgctgcttacatctcgctttgactatgctggtgggtttgataagatctgggactacaagctacttgtctacgtaactgatgacaacttgatgtctgacaggaagaaagcggaggctcttgttgagacaggaacagtgacactgagtattaaagtcattccccacccaaccactatcatcaccacgacccccaggcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctaaaaaaaaaaacagaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacactatgaactttcttgtacatgtcttttggtgaacataaacactcacttttttgctcatatatctaagagtgggattgctggagcaattgctggatctgccaaagagttccaaagtggtggctctgattcacattccagcagcaaacactgagagttgcaattgctctctatccttgccaacacttgggattgtcaatccttttaactttagccattctggttaaaattactattgaagtgaaatcactttttcctcaaagctgaaacaccatcagccttacaacctacctgccttgctccttcccacttcctatgattggaaggaactgcaggactctgagtggggacatactggaagccccatctagacataaaactcagacttccacctgtaggcatgagcaatgaactgggaataaatggtattatgatggaataggaaatgtaactttccaatgtgtgcctagcagagcctgagcaagcttcactcgagctctatgccctgctgcccagctgctgcgaccctagtccagtaaccctaagaaaggtccaggtgagtgttcattagggaagcactcccttcccaactggggagtcaggtgagagcctaccaggtccacaaggtcctgtgggagacagactggatccagcaaatgtagagcttcagagagagcagcagcttgtttactgtgtgcctagtgccagtgtcacttctcaagcaaaagaagcatttgcaaaatgcctgtcctggcctagattgagcgtgatttattaataagggttggttgccagggaactcccttgaatggatttaaactttgcaaaagaaggcagaactgttcatttatgcaggttaaagtgagtgaagtggctgattgcccatttaaggcattgcaaatctgtggggcccggagtcaaatgctttccttggaagctctcagcttcaatgcaagtaaaatgaggttctgagaaggctgaagggggacttaataactgcttataagcccattaagaatgattaaaagggccgggtgaggtggctcatgcctgtaatcccagcactctgggaggctgaggcaggtggatcacctgaggtcaggagtttgagaccagcctggccaacatggtgaaaccctgtctctactaaaaaatagaaaaattagctggacgtgttagcaggcacctgtaatcccagctactcaggaggctgaggcaagagaatcgcttgaacccaggaggcagaagttgcagtgggctgagattgcgccactgcactccagcctgggtgacaagggcaaaactctgtgtcaagaaaaaaaaaaaaaaaagaataattaaaaggagagagtggtgagcagctggtctttcttctccagtgatgacagggcaagagggaattgtgcttaatggccagagaagagatttaagtcaggcaccaagagggacttcctgaagcctggggcctctctgaagagctcagtgtcttctctggtgataggcaggaagagctgagtgtcttcctagtcgcaaggcaagcctcgagaaactcaagaaataggggcaagagtgcgccaggaggagagaacacctgctgccccgtttcttttgtatatccggctatttggttcggggaaatccagaagtcaaagtgtcaccggtggagggtcttgactgcaagttgtccaagttcttggagttttgaacaaagaatggaacaaaatgcccagcaaagcagagaaagaatgaggcaacgaaagaatgaaagcagggatttattgaaaaccaaagtacactccacagtgtgggaacgggcctgagcaagtgactcaagggcccagatacagtcttctcagtccaaataccccttggaggtttccccttggccacttcatgctcacctcatggaaatgaagtagtggaccacaattggtctgattggttgcaggaagcaaccaatcagagactgaagtggagttacaaaggtcacgctcctgtgcaaacatctgattggttgcaaaaagcaaccaatcagaggctaaggtgaagttacaacgttgcaacgaagactcggctggcaatcagtctgattggttacagacagccaatttcccagcgttgaccaggttttggggggaacaaaattatctgaataaaatgaagacagcaaccgtcgtggatttggtgaaagttttctcccatctccctctcaaggccttaaacaggtatgagttgattatagccaatgtttacttttctcattctgattcattataaaactggggtaaatacgttcaggaattagaccacgtaacaattataattgtcgaagactttgaaactgcatagtagattgtgacattggagctttttgttgtgctcattagaaagcagggtctgaaactcagcctgtgtagcaagcacgggtggctcacaagcagaactgggaaatgacacttctgctccccagagccccctttcacatctggggttctcattgtttgcctttttacttaatgtattttgtaatggctgtgaaaattaagctacaaaatgagtgaacattgaagacaatgattgctattgaaacttaggatttctcatttcaaacttagcgtgtgtttatccttcgtattcattcaataaatatctgtggagcaacta

SEQ ID NO: 782 - DNA, 2874 bp, Homo sapiens
aaagggcgtcgcccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggtgtcaaagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctcccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcacagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctcaaaaaaaaaaaaaaaaaa

SEQ ID NO: 783 - DNA, 1993 bp, Homo sapiens
agcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccaggtgtcaaagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctcccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaacta

SEQ ID NO: 784 - DNA, 783 bp, Homo sapiens
cgcctctgatccaagccacctcccgccaggtgagccccgagatcctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttcccc

SEQ ID NO: 785 - DNA, 1598 bp, Homo sapiens
gcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 786 - DNA, 661 bp, Homo sapiens
atgggcaacaagcagacagtcttcacacacgagcagctggaagcgtatcaggactgcacatttttcacaaggaaggagatcatgaggctcttctatcgctaccaggacctggccccacagctcgtgcccctcgactataccacctgccccgatgtgaaggtgccctacgagctcattggcagcatgcccgagctgaaggacaaccccttccgccagaggattgcccaggtattctctgaggatggggatggccacatgaccctggacaactttttggacatgttttccgtgatgagtgaaatggctccccgcgacctcaaggcttactatgcttttaaaatttatgattttaacaacgacgactacatttgtgcgtgggacctggagcagacggtgaccaaactgacgcggggggggctgagtgccgaggaggtgagcctggtatgtgagaaggtgctggatgaggctgatggagaccatgatgggcggctgtccctggaagatttccagaacatgatcctccgggcaccagacttcctcagcaccttccacatccgaatctgatggcaccacagaggagccgagctataggagggcggggtgacccctcacccgctgtggactctggtttctgagaataaacacaagtcactgagtcaca

SEQ ID NO: 787 - DNA, 467 bp, Homo sapiens
atgggcaacaagcagacagtcttcacacacgagcagctggaagcgtatcaggacaaccccttccgccagaggattgcccaggtattctctgaggatggggatggccacatgaccctggacaactttttggacatgttttccgtgatgagtgaaatggctccccgcgacctcaaggcttactatgcttttaaaatttatgattttaacaacgacgactacatttgtgcgtgggacctggagcagacggtgaccaaactgacgcggggggggctgagtgccgaggaggtgagcctggtatgtgagaaggtgctggatgaggctgatggagaccatgatgggcggctgtccctggaagatttccagaacatgatcctccgggcaccagacttcctcagcaccttccacatccgaatctgatggcaccacagaggagccgagctataggagggcggggtgacccctcaccc

SEQ ID NO: 788 - DNA, 354 bp, Homo sapiens
atgggcaacaagcagacagtcttcacacacgagcagctggaagcgtatcaggactgcacatttttcacaaggaaggagatcatgagattttaacaacgacgactacatttgtgcgtgggacctggagcagacggtgaccaaactgacgcggggggggctgagtgccgaggaggtgagcctggtatgtgagaaggtgctggatgaggctgatggagaccatgatgggcggctgtccctggaagatttccagaacatgatcctccgggcaccagacttcctcagcaccttccacatccgaatctgatggcaccacagaggagccgagctataggagggcggggtgacccctcaccc

SEQ ID NO: 789 - DNA, 773 bp, Homo sapiens
gcgagtccttgaggctgaggttctactgctggcagacagaaaggtgtggttggcatggggcaatgcttgaggtatcagatgcactgggaggacctggaagagtaccaggccctgaccttcctgaccagaaatgaaattctgtgcatccatgacaccttcctgaagctctgccctcctgggaagtactacaaggaggcaacgctcaccatggaccaggtcagctccctgccagctctgcgggtcaaccctttcagagaccgtatctgcagagtgttctcccacaaaggcatgttctcctttgaggatgtgctgggcatggcatctgtgttcagcgagcaggcctgcccaagcctgaagattgagtatgcctttcgcatctatgattttaatgagaatggcttcattgatgaggaggatctgcagaggatcatcctgcgactgctgaacagtgatgacatgtctgaggacctcctgatggacctcacgaaccacgtcctgagtgagtcggatctggacaatgacaacatgctgtccttctcagagtttgaacatgcaatggccaagtctccagatttcatgaactcctttcggattcacttctggggatgctgatgtagcggcaaacacctgacatggcagcctcgagggagaccacaggaatcgaaccccctccagcactggagggagctggtttgaagtatgactttgtactgggcccacactcacctctagaatattgtttattagataaaagaaaaagcttttccttagcc

SEQ ID NO: 790 - DNA, 2520 bp, Homo sapiens
gagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatggccaagtttctttcccaagaccaaattaatgacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttattaactaccgtgagtccggccctttcaagcatggaaggagcctgcggtttggagtctggcctgggttccagtcctggctctgctgcttcccactgtgactttgggcaaatcatttcactcctcaaagcccccccacacaagctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaaggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtc

SEQ ID NO: 791 - DNA, 987 bp, Homo sapiens
agggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatggccaagtttctttcccaagaccaaattaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttatt

SEQ ID NO: 792 - DNA, 1445 bp, Homo sapiens
ccggcactaagaggcctcactccaagcccccgaggagcctgtggtggggctggagacccggctcaggcccctccaccacccttaaagtcctcagaaggtgggaactgaactggcacaggatgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttatta

SEQ ID NO: 793 - DNA, 876 bp, Homo sapiens
agaactgtctgggacagacgctgcccggatccctgcggctgcctgcactctggaccacgagctctgagagcagcaggttgagggccggtgggcagcagctcggaggctccgcgaggtgcaggagacgcaggcatggccggtgagctgactcctgaggaggaggcccagtacaaaaaggctttctccgcggttgacacggatggaaacggcaccatcaatgcccaggagctgggcgcggcgctgaaggccacgggcaagaacctctcggaggcccagctaaggaaactcatctccgaggttgacagcgacggcgacggcgaaatcagcttccaggagttcctgacggcggcgaagaaggccagggccggcctggaggacctgcaggtcgccttccgcgccttcgaccaggatggcgacggccacatcaccgtggacgagctcaggcgggccatggcggggctggggcagccgctgccgcaggaggagctggacgccatgatccgcgaggccgacgtggaccaggacgggcgggtgaactacgaggagttcgcgaggatgctcgcccaggagtgaggctccccgcctgtgtccccctggctgcgctctgagccttcagggccaccgcccgctgctgcttttgtgctgggactctccggggaaacctggtcggtggatgggaaactgcctccccctgggaggaaggctttgcgctccggggcctggatgcggcgccctcgggccgcctgcgagcccctctctgcctccagaccttgggcagaaggaggcctccttgggcctggtccccctttgccctgcagtggaatgagggcccctcagccccgcattgatctaaataaaggactgccgagttccatg

SEQ ID NO: 794 - DNA, 2683 bp, Homo sapiens
aagcagacaccagcactgctctttctccaagacggccggccatgctctcctcctctgccagtctcctccaccactctctaacctgagagcctgtggaacctgcccgtctcccctcctccatcagacacacctgcctaggaaacaggaaaggacctcggaagtcttctaaggagagtcatggcgtattaccaggagccttcagtggagacctccatcatcaagttcaaagaccaggactttaccaccttgcgggatcactgcctgagcatgggccggacgtttaaggatgagacattccctgcagcagattcttccataggccagaagctgctccaggaaaaacgcctctccaatgtgatatggaagcggccacaggatctaccagggggtcctcctcacttcatcctggatgatataagcagatttgacatccaacaaggaggcgcagctgactgctggttcctggcagcactgggatccttgactcagaacccacagtacaggcagaagatcctgatggtccaaagcttttcacaccagtatgctggcattttccgtttccggttctggcaatgtggccagtgggtggaagtggtgattgatgaccgcctacctgtccagggagataaatgcctctttgtgcgtcctcgccaccaaaaccaagagttctggccctgcctgctggagaaggcctatgccaagctgctcggatcctattccgatctgcactatggcttcctcgaggatgccctggtggacctcacaggaggcgtgatcaccaacatccatctgcactcttcccctgtggacctggtgaaggcagtgaagacagcgaccaaggcaggctccctgataacctgtgccactccaagtgggccaacagatacagcacaggcgatggagaatgggctggtgagtctccatgcctacactgtgactggggctgagcagattcaataccgaaggggctgggaagaaattatctccctgtggaacccctggggctggggcgaggccgaatggagagggcgctggagtgatgggtctcaggagtgggaggaaacctgtgatccgcggaaaagccagctacataagaaacgggaagatggcgagttttggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctggctggctcacagcggttccgggagaaatttccacccgtgtttttttcctcgttcagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaactgaaagtgaatgggcggctagaccaagaggagtttgcgcgactgtggaagcgccttgttcactaccagcatgttttccagaaggttcagacaagccctggagtcctcctgagctcggacttgtggaaggccatagagaatacagacttcctcagagggatcttcatcagccgtgagctgctgcatctggtgaccctcaggtacagcgacagcgtcggcagggtcagcttccccagcctggtctgcttcctgatgcggcttgaagccatggcaaagaccttccgcaacctctctaaggatggaaaaggactctacctgacagaaatggagtggatgagcctggtcatgtacaactgaagcaaagaggaaagcagacccatggctcaggacaagctcccagtgatcactcaagaatctggctctcattctaagaggctgtgctgcccagtatggtggttgtgataaatctaaaccagccctgcatgaaacagagtccaagctgtctcccaacagcctgggttcggtccttggctggcccaggcccagttaagcctgtggccaccaagcagctcatctgagcactttgggatgtattcagcctacgttgccctggaaaaggaagcaggagatgtctccctgtgggaaaggagaagagaagttgtctctgagtcccctgtcaccagttggattcatttcttggaagagccagaatgagccactttgaccaccctcgggtgctatgggtgacacaagagctgtccactgggtgtttgcagaataattacactatcttatgtctggatcctgatgatttcacagctaaatggcaaaaataaaacatgtttcccataaa

SEQ ID NO: 795 - DNA, 2677 bp, Homo sapiens
agcagacaccagcactgctctttctccaagacggccggccatgctctcctcctctgccagtctcctccaccactctctaacctgagagcctgtggaacctgcccgtctcccctcctccatcagacacacctgcctaggaaacaggaaaggacctcggaagtcttctaaggagagtcatggcgtattaccaggagccttcagtggagacctccatcatcaagttcaaagaccaggactttaccaccttgcgggatcactgcctgagcatgggccggacgtttaaggatgagacattccctgcagcagattcttccataggccagaagctgctccaggaaaaacgcctctccaatgtgatatggaagcggccacaggatctaccagggggtcctcctcacttcatcctggatgatataagcagatttgacatccaacaaggaggcgcagctgactgctggttcctggcagcactgggatccttgactcagaacccacagtacaggcagaagatcctgatggtccaaagcttttcacaccagtatgctggcattttccgtttccggttctggcaatgtggccagtgggtggaagtggtgattgatgaccgcctacctgtccagggagataaatgcctctttgtgcgtcctcgccaccaaaaccaagagttctggccctgcctgctggagaaggcctatgccaagctgctcggatcctattccgatctgcactatggcttcctcgaggatgccctggtggacctcacaggaggcgtgatcaccaacatccatctgcactcttcccctgtggacctggtgaaggcagtgaagacagcgaccaaggcaggctccctgataacctgtgccactccaagtgggccaacagatacagcacaggcgatggagaatgggctggtgagtctccatgcctacactgtgactggggctgagcagattcaataccgaaggggctgggaagaaattatctccctgtggaacccctggggctggggcgaggccgaatggagagggcgctggagtgatgggtctcaggagtgggaggaaacctgtgatccgcggaaaagccagctacataagaaacgggaagatggcgagttttggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctgacttcagtccagcggttccgggagaaatttccacccgtgtttttttcctcgttcagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaactgaaagtgaatgggcggctagaccaagaggagtttgcgcgactgtggaagcgccttgttcactaccagcatgttttccagaaggttcagacaagccctggagtcctcctgagctcggacttgtggaaggccatagagaatacagacttcctcagagggatcttcatcagccgtgagctgctgcatctggtgaccctcaggtacagcgacagcgtcggcagggtcagcttccccagcctggtctgcttcctgatgcggcttgaagccatggcaaagaccttccgcaacctctctaaggatggaaaaggactctacctgacagaaatggagtggatgagcctggtcatgtacaactgaagcaaagaggaaagcagacccatggctcaggacaagctcccagtgatcactcaagaatctggctctcattctaagaggctgtgctgcccagtatggtggttgtgataaatctaaaccagccctgcatgaaacagagtccaagctgtctcccaacagcctgggttcggtccttggctggcccaggcccagttaagcctgtggccaccaagcagctcatctgagcactttgggatgtattcagcctacgttgccctggaaaaggaagcaggagatgtctccctgtgggaaaggagaagagaagttgtctctgagtcccctgtcaccagttggattcatttcttggaagagccagaatgagccactttgaccaccctcgggtgctatgggtgacacaagagctgtccactgggtgtttgcagaataattacactatcttatgtctggatcctgatgatttcacagctaaatggcaaaaataaaacatgtttccc

SEQ ID NO: 796 - DNA, 2197 bp, Homo sapiens
atataagaggtggtttcaggctgcatgcttctgactgcaccgggattagagcttgcccaggcgcttaaagaagcaaaatctcctgtgcaggagcagcagagactcctcaggaagactcactggactgtacccaccacctgccatgtctctgtggccacctttccgatgcagatggaagctggcgccaaggtactctaggagggcgtctccacagcaaccccaacaggactttgaggccctgctggcagagtgcctgaggaatggctgcctctttgaagacaccagcttcccggccaccctgagctccatcggcagtggctccctgctgcagaagctgccaccccgcctgcagtggaagaggcccccggagctgcacagcaatccccagttttattttgccaaggccaaaaggctggatctgtgccaggggatagtaggagactgctggttcttggctgctttgcaagctctggccttgcaccaggacatcctgagccgggttgttcccctgaatcagagtttcactgagaagtatgctggcatcttccggttctggttctggcactatgggaactgggttcctgtggtgatcgatgaccgtctgcctgtgaatgaggctggccagctggtctttgtctcctccacctataagaacttgttctggggagcacttctggaaaaggcctatgccaagctctctggttcctatgaagacttgcagtcaggacaggtgtctgaagcccttgtagacttcactggaggggtgacaatgaccatcaacctggcagaagcccatggcaacctctgggacatcctcatcgaagccacctacaacagaaccctcattggctgccagacccactcaggggagaagattctggagaatgggctggtggaaggccatgcctatactctcacaggaatcaggaaggtgacctgcaaacatagacctgaatatctcgtcaagctacggaacccctggggaaaggtggaatggaaaggagactggagtgacagttcaagtaaatgggagctgctgagccccaaggagaagattctgcttctgaggaaagacaatgacggagaattctggatgacgctgcaggactttaaaacacatttcgtgctcctggttatctgtaaactgaccccaggcctgttgagccaggaggcggcccagaagtggacgtacaccatgcgggaggggagatgggagaagcggagcacagctggtggccagaggcagttgctgcaggacacattttggaagaacccgcagttcctgctgtctgtctggaggcccgaggagggcaggagatccctgaggccctgcagcgtgctggtgtccctgctccagaagcccaggcacaggtgccgcaagcggaagcctctcctcgccattggcttctacctgtataggatgaacaagtaccatgatgaccagaggagactgccccctgagttcttccagagaaacactcctctgagccagcctgataggtttctcaaggagaaagaagtgagtcaggagctgtgtctggaaccagggacgtacctcatcgtgccctgcatattggaggcccaccagaagtcagagttcgtcctcagggtcttctccaggaagcacatcttttatgaaattggcagcaattctggtgtcgtcttctcaaaggagatagaagaccaaaatgaaaggcaggatgaattcttcaccaaattctttgaaaagcatccagagattaatgcagttcaacttcagaacctcctgaaccagatgacctggtcaagtctggggagcagacagcccttctttagcctggaagcctgccaggggatcctggccttactggaccttaatgcatcaggtactatgagcatccaggaattcagggacctgtggaagcagctgaagctctctcagaaggttttccacaagcaagaccgtgggtcaggatacctgaactgggagcagctgcacgctgccatgagggaggcaggaatcatgctcagtgatgacgtctgtcagctgatgctcatccgctacggcggcccccgcctccagatggactttgtcagtttcatccacttgatgctgcgtgtagagaacatggaggatgtcttccaaaacttaacccaagatggcaaagggatatacctccagaagccagagtggatgatgatggcactgtactcctga

SEQ ID NO: 797 - DNA, 3820 bp, Homo sapiens
atataagaggtggtttcaggctgcatgcttctgactgcaccgggattagagcttgcccaggcgcttaaagaagcaaaatctcctgtgcaggagcagcagagactcctcaggaagactcactggactgtacccaccacctgccatgtctctgtggccacctttccgatgcagatggaagctggcgccaaggtactctaggagggcgtctccacagcaaccccaacaggactttgaggccctgctggcagagtgcctgaggaatggctgcctctttgaagacaccagcttcccggccaccctgagctccatcggcagtggctccctgctgcagaagctgccaccccgcctgcagtggaagaggcccccggagctgcacagcaatccccagttttattttgccaaggccaaaaggctggatctgtgccaggggatagtaggagactgctggttcttggctgctttgcaagctctggccttgcaccaggacatcctgagccgggttgttcccctgaatcagagtttcactgagaagtatgctggcatcttccggttctggttctggcactatgggaactgggttcctgtggtgatcgatgaccgtctgcctgtgaatgaggctggccagctggtctttgtctcctccacctataagaacttgttctggggagcacttctggaaaaggcctatgccaagctctctggttcctatgaagacttgcagtcaggacaggtgtctgaagcccttgtagacttcactggaggggtgacaatgaccatcaacctggcagaagcccatggcaacctctgggacatcctcatcgaagccacctacaacagaaccctcattggctgccagacccactcaggggagaagattctggagaatgggctggtggaaggccatgcctatactctcacaggaatcaggaaggtgacctgcaaacatagacctgaatatctcgtcaagctacggaacccctggggaaaggtggaatggaaaggagactggagtgacagttcaagtaaatgggagctgctgagccccaaggagaagattctgcttctgaggaaagacaatgacggagaattctggatgacgctgcaggactttaaaacacatttcgtgctcctggttatctgtaaactgaccccaggcctgttgagccaggaggcggcccagaagtggacgtacaccatgcgggaggggagatgggagaagcggagcacagctggtggccagaggcagttgctgcaggacacattttggaagaacccgcagttcctgctgtctgtctggaggcccgaggagggcaggagatccctgaggccctgcagcgtgctggtgtccctgctccagaagcccaggcacaggtgccgcaagcggaagcctctcctcgccattggcttctacctgtatagggtagcaaagtaccatgatgaccagaggagactgccccctgagttcttccagagaaacactcctctgagccagcctgataggtttctcaaggagaaagaagtgagtcaggagctgtgtctggaaccagggacgtacctcatcgtgccctgcatattggaggcccaccagaagtcagagttcgtcctcagggtcttctccaggaagcacatcttttatgaaattggcagcaattctggtgtcgtcttctcaaaggagatagaagaccaaaatgaaaggcaggatgaattcttcaccaaattctttgaaaagcatccagagattaatgcagttcaacttcagaacctcctgaaccagatgacctggtcaagtctggggagcagacagcccttctttagcctggaagcctgccaggggatcctggccttactggaccttaatgcatcaggtactatgagcatccaggaattcagggacctgtggaagcagctgaagctctctcagaaggttttccacaagcaagaccgtgggtcaggatacctgaactgggagcagctgcacgctgccatgagggaggcaggaatcatgctcagtgatgacgtctgtcagctgatgctcatccgctacggcggcccccgcctccagatggactttgtcagtttcatccacttgatgctgcgtgtagagaacatggaggatgtcttccaaaacttaacccaagatggcaaagggatatacctccagaagccagagtggatgatgatggcactgtactcctgagaaggctgagtctcacctgccctcactgaagactctgcatgtggcccaagagcagcctttggctgagaccaacccatgcccaccctacttactgatcttcaggacagcctcactagccgtcaccttctcagctgggaaggtttctcttctgcagccctccccgtgcatggccagcatgcagaaagggaagggaggaagtaaagattacatcagatttgtaaaagctagccatccttccctgaggccacaaccttgtcacaagcggagatgttacctgacatggcctaagcattctgactccagagctggtgtggttagcctccatacaacactgcctctgtggctgcaaactcaagtgactttagacatgccacatgttctcacatggtggggtaatcatctaggttttaaggtctgaaatgggaatgatatatccttagacatttagtcccagcatctgcaaattgatagagacataggctaagtttcagctgtttggggatggggtcagggatatagtgggctttcagaaacacagacagtaagagaattggcagagtccaggtggggtgggctggctctggcatctgaggtcatggggtagtcttcttctgacaatatctccgtatgattggatctggggcaacctagtagatttaaaacacctgagttctcaaagggcttcctgcttgtgacaggtgtgtctatttgcttgatatatagactatcagatccatttcaaatctgtccagaaattctctgtctatctacttcaaaggacaaaaacaaacccatgctaaattatagagtcaatcagtgggtggttggtatatctgattttttgaactaccatgaaacaccttgtttatgtcatccctctcaaccaagaatacaggtgcaaaaccagaacaatggcctttttccaaagtctatgcaatttattcataagttagcacctcagagccatttattactacaggttgagcatcccaaatctgaaaaccccaaatctgaaatactccaaaatctaaaatttctgagagtagacatgaaactcaaaggaaataggggcattttggattttgaatttttgggtttgaggtgttcaactgacaagtctataatgcagatatcctgaaatctgaaacacttctggtcccaagcattttagttaagagatagtcaacctgtattctatttaatcttaatttacaaacaattctaacaaacatggctgtttgatttccaactccatagcagactcaggaaggaagctgaatgaagagataaaagtgtgtccattggcagaggactaaaggagatttgagcacctgtcagatgggtactgtaccagaagaaaggagcactttgaaagcgtagcttatggggtaggaaagtattttatttaggaaaaaaaacccttcatttattccaaatgataaaatgtaaaatgggtttccataaagtgccagatacatgagatgttgttgattttataaatgatgatcatgtatttacagccttttacagttttttatatccattgacttatttgtgtctttgtctttaaaatctgccattgcaaatagctgttttaataaaccaattttgccttggcccctg

SEQ ID NO: 798 - DNA, 2262 bp, Homo sapiens
atggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgacgcttctccagtcatctctccctctgcggaagggtgtcgtgtaaaacacacaacaatgagatcgatgtcacagatgtcactttcagatttcgtgaggcagttctctcggttggagatctgcaacctgtccccggactctctgagtagcgaggaggtgcacaaatggaacctggtcctgttcaacggccactggacccggggctccacagctgggggctgccagaactacccagccacgtactggaccaatccccagttcaaaatccgtttggatgaagtggatgaggaccaggaggagagcatcggtgaaccctgctgtacagtgctgctgggcctgatgcagaaaaatcgcaggtggcggaagcggataggacaaggcatgcttagcatcggctatgccgtctaccaggtactgctgtgctggtatacacttgatgttttggggctgaatatcttggccagtcattgtagcacatctttcctattgctggaagaagcgtccttgctcctctatatacctctcccagtggccttactgagatttagagattcattcctatggcttaacaccaggaggctcaggcgtatctgcccacaagcctgccatgatgctctccccttttggcagagaccaagttcggttccacacccttggatggtatctttggaggtcttctaccgtggaggttctttccctcaccttcaaatgatccgattcccactccccttttctagaacagacataaaattcgatggattcaacatcaacacttgcagggaaatgatcagtctgttggatagcaatggaacgggcactttgggggcggtggaattcaagacgctctggctgaagattcagaagtatctggagatctattgggaaactgattataaccactcgggcaccatcgatgcccacgagatgaggacagccctcaggaaggcaggtttcaccctcaacagccaggtgcagcagaccattgccctgcggtatgcgtgcagcaagctcggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagcc

SEQ ID NO: 799 - DNA, 2596 bp, Homo sapiens
ctcccctcccagtggagcaggtgtctgagagtacagtgcagccctgcccttctgtccaccctacagagcccacggccatggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgatgcaccagagtggaatcacatagacccccggcggaaggaagaactggacaagaaagttgaggatggagaattctggatgtcactttcagatttcgtgaggcagttctctcggttggagatctgcaacctgtccccggactctctgagtagcgaggaggtgcacaaatggaacctggtcctgttcaacggccactggacccggggctccacagctgggggctgccagaactacccaggctcctcctaggttgaatcagctgaggcagcacctgatgaagaaactcaggaagacagccccacatctctaaggagaaatgaagaaaagcaaatcctgctctctctacttttcacctcctgctccccatgttccctgcctggtttgctgttgatctgttgattgacttagactgtaagcgcatggggcagggccagtcactttcttctcatgacagagctcactgcagggctgtgctcggtgctagggaagcagcattagaataaaaccccacctggatgcagtgctgggtcttgacaagttctctcttctttcatcacccatccaacccaaagctcccggttcaggcagctgtgaccagagtgctgaacagagaggaaggaaaggggtccacatcctgcccttgttgcttgatttagactctgggaagggcatttccctcttctgagcttcagtttcctagtcctccagatggggttcaaccttccaaccttactgggtcactgcaagccttggaacacagagtgtgtagggaagcactttgtaaactgtgtagcattatataaatgggagtattatttttatggcccattctcttcctccagtactgttaaggagtaaacaaaaaatgtatggattgcagtaatgttgcatttgggagaaattaaaatatgctcaccattagcaagctcttagaaaatgtggaggaaatttgcatggatcattttgggagctcagaactgtagggggtgcacaaggtatctggatgcaccaaatcacagtcccatccatgctgccaactagctgtcaggaagacatggatagttcctgccctttggtagtgatggaagtataggcgattacagatttttttttccatctcctatgggatccacagatatccggctttaaaatccataaacttgagccctaaaacaaacaaacaaacaaaacacagcaacaaaaaaacaaaacaaaacaaaacaaacaacccccccccccaaaaaaaaagtggaagtggggattctgagaaggtggaattgaataagtaatcctactgtaaagaaaagtgataatcaatggctcttggtcacctgtgaatgccttgttattttccaagttagactcttctttaaaggatgtaaggaaaaatcccatgcccttccacttcttttttcctcccgggcacatcattattgaaattgttgaggccctagagtggagacacctgtcaggcgtgccttctgcaattttgctctgccactggactctgtcatagacttgctgcatatccttggatgatccttttaatctctccgtgccttggcttgtgtacttactattctgagagatttaaaaaaagccatctttgaaatgaaggagtc

SEQ ID NO: 800 - DNA, 1399 bp, Homo sapiens
gtgccttatagctcccctcccagtggagcaggtgtctgagagtacagtgcagccctgcccttctgtccaccctacagagcccacggccatggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgatgcaccagagtggaatcacatagacccccggcggaaggaagaactggacaagaaagttgaggatggagaattctggatgtcactttcagatttcgtgaggcagttctctcggttggagatctgcaacctgtccccggactctctgagtagcgaggaggtgcacaaatggaacctggtcctgttcaacggccactggacccggggctccacagctgggggctgccagaactacccagccacgtactggaccaatccccagttcaaaatccgtttggatgaagtggatgaggaccaggaggagagcatcggtgaaccctgctgtacagtgctgctgggcctgatgcagaaaaatcgcaggtggcggaagcggataggacaaggcatgcttagcatcggctatgccgtctaccag

SEQ ID NO: 801 - DNA, 2361 bp, Homo sapiens
gtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 802 - DNA, 2445 bp, Homo sapiens
gcagtggagcttgactcttaatggtgagcaaggcaaatgaggcagacaggtggaggggcgaccactgattctgcttcaccagtgttaaataatgtaatcaagagccagtcatattttacagcgaagcgggtcggtttgggaaataactcataccttggggtgggtcggccctcttctcagcaatggctttccttacctggaccaggcggacagggtcccaaagcaaaaaagtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 803 - DNA, 1558 bp, Homo sapiens
caatttctgctccgactctgcggactactgcagtggagcttgactcttaatgggtcccaaagcaaaaaagtctggcagtaagaaaaagaaagtcaccaaagctgaacgattgaagctgctacaagaggaggaggagagacgactgaaagaggaaggtacaaaataaatagtgatactatttacctatacagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaagtggtgacagagcacaaagactgaagatcaa

SEQ ID NO: 804 - DNA, 2363 bp, Homo sapiens
gggagcgtttgtccacacaatttctgctccgactctgcggactactgcagtggagcttgactcttaatgggtcccaaagcaaaaaagtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 805 - DNA, 2417 bp, Homo sapiens
gtcgtccgggcaacccgggagcgtttgtccacacaatttctgctccgactctgcggactactgcagtggagcttgactcttaatgggtcccaaagcaaaaaaggaacactgtcatcacaaacaggcttcagtggccaaagatctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 806 - DNA, 2347 bp, Homo sapiens
acacaatttctgctccgactctgcggactactgcagtggagcttgactcttaatgggtcccaaagcaaaaaagtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgc

SEQ ID NO: 807 - DNA, 2208 bp, Homo sapiens
ctgtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaaggatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgc

SEQ ID NO: 808 - DNA, 583 bp, Homo sapiens
acacaatttctgctccgactctgcggactactgcagtggagcttgactcttaatgagtttcgctctgttgcccaggctggaatgcaatggcgcgatctcggcttactgaaacctctgcctcccgggttcaagcgattctccttcaagcgattctcctgcctcagcctcccgagtagctgggattacagtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattga

SEQ ID NO: 809 - DNA, 2146 bp, Homo sapiens
aatttctgctccgactctgcggactactgcagtggagcttgactcttaatggatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatc

SEQ ID NO: 810 - DNA, 1825 bp, Homo sapiens
gcgcgcggagagctctggctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccagggtcgtctaagtgagaggaaaagggagagggcggttgagaccaggccctgaattccgcgttcatcttatcctgaggtattcagtgccgagtgtggccttggtgctaggattcaaagaggaaaggaagaaaactttccattctaaaagaaactccacgtgaggcgaagaagatgaaatatagtcagaaaaccataccagtaggtgttaagttgataaatgatgcatacgacatcctatagaagactgtcaccaccccacctcactgatcagccctctgcctacagccacacccacagaacattcagccatttctcctgtggttcccagcctgcagcacagcgtctgcacgtggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagagtccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctg

SEQ ID NO: 811 - DNA, 1010 bp, Homo sapiens
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaa

SEQ ID NO: 812 - DNA, 1294 bp, Homo sapiens
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 813 - DNA, 1294 bp, Homo sapiens
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 814 - DNA, 1953 bp, Homo sapiens
tccctttaccccccctcagcctcctcccgcctggctggcgccggatccgcgagcagcagtgtccacctcacgtagctggccgaggcggtatccagattccgggggtctcgctccttggcatagtggtcgcttaactccagcgccttcccagtgcctcccaaacctctcctcctcctgcccggggctgttctaggaggagcctaaatgtccgcttccccagctgaaggggattgtggtgcgtaaacaggattaactccctcgcccccagctgcgcggatctgcgcggcggcctgcgggccagagcgagccttcgggtgcgtggagggcgcagcactggagcgggggatggggaagcgcgcggccttggagccgtctcttgggcccgcttcctcgccgagtggggaggggggccacagcctaaggagctgctcctcaaaagcccgggcggacggcggcgacggcgcgggttcctagcggcagcctcagctccaccacctccctcaccctccccgcgcttcctctccgcccctcgcgctccagccactcggccgcagccggcgctgtcctccgccccccggagccgccgcgccagaccctcgcccagacatgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccgttcacagacattgggaccttcgagacagtgtggcaagtcaagttctacaattaccacaagcgggatcactgccagtggggaagccccttctctgtcattgagtatgaatgcaagcccaacgagacacgcagtctgatgtgggtgaacaaggagtccttcctctgaaagtggctctttctgatgctactggacaatcttttcagaaatctacttttagataaaccagcgcaggccttaaacaaggcatgccacaccattgctgttccccatctggtactaatgacctactagccctggttattttgaaagtgtaattcccctctgacacaatatccctcacatacaagatggtgatgtaccactcccgagaatattcccatctgtattttgtgctgatgttcctgcatccagttgttctcggtcatacttttgaccacttgtgactggagttcagtggccctggcaggcttgtcctgctcttgaccattccactgactaactttggtgttttgtttccaagttaagtgattcctccttttttttgttcaatgttaaatttaaaaataacaatgtgtatgggtcctcccatgtgtaatatggtaacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagcctagtagaaatgggggaaaagcattgctgtggaccattgttaaagtgacaggagttgtagggttacccctttgacaagcttccatagtcttcagacacgcacattgatggcatccctacagtcttcttcacttgaactttgtaaaactgcatatggacctgtaatcaacttttgatatttcttaataaaggcgttgaaaatca

SEQ ID NO: 815 - DNA, 644 bp, Homo sapiens
atgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccggagtgcctggaacaacgaccccaagagatctctcttacatatgaatgtgaagaataagcacattcttcaatgtgtgccatcatgaggaacaaatgttcttttttttttttccaaattatttgctttgcattctaggggagggcttctcacaggccatcagaattatcggggatgcttgttaaaatgtagattcctaaactctacctttttagacctcttaaattgagcaaactctctgagagtaaatccaaagcatctgcattttattaagcactttaggtgattcttatcatattaaagtttggaaaacacta

SEQ ID NO: 816 - DNA, 2378 bp, Homo sapiens
aatcctcttggtgggtgctgaaacaatgccgggagagcaaagccgctgagagtttgtcccgttagatccaggcgtgaaggacggactgtactacagggagcagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcgtgtgaaactataatagaagagtatgaagatgaaatatcctcacttatcgcccaggagacacactatctagctgacaagctgtgcagtgaaaaatcagatctgtgtgaaacttctgctaatcatactgagctctaggagtgccgttctgctggtcgtagagaggagtaaagtcacacccaaaggtcaatgtctgcattttatgtttgcatgttgtctttcatgataagaaaaattttgtctcttgtttataccgtgtttgtctccgtttatgattcattttgaaaatctgttggttgacatcatgacaaaccctgcgtttttttataggtgaagctgaggagtacatgaaacttaaattaacctttgcagattttgataaatcaagcttgacaatagaggatttaattctgtattgaggaaaaaagcgaagacatttcataaacaaaatagggatttcataatgtatgctgcttattttataacagtgtatgtgcacatatgcaagcgcagtggctgtctgataagaactggatttgaatcctcaaatacttgattgcctataaatttaaggaaatacatggcaacaaattcaaaatgtggccttctgggtgagatatggctattagtgaaagaaacccactttttatcaggaatgaaattaaaatttttagaaaccacaagtttaaaaacccatctctaaaatttagtggaatgtgtaaaaactaatgaatgctttaatttatagtaaacaataattatattggcctctcaaacaccattctgagtttaagtggcttagaaagttgatttattattgcatcaggtgttaaaagatgacactagtgattgcgttttgtttcgctccaaactcttctggcttgtttgtttttcttctaaacgttttttttttggctcacatttagtgtgttgagtttactactaaataatctaccattcttctacaggaatggaaaaagagttgggacctggtgggaaattatcttttggccacacttaatatacaaagtctagtaacaatcactcccggaaatttctttatctctgttacatttgcattcaatggaatctgactttaatgattaaaaatgtcagggtatggtctacaccagtttctaaaaagagattctcattgtctttggtgacaatcaagtgggtaggatgctacaaatcccccccccaacccccccgacccaaaactctttgccatattgttacttagttgcttaaaaagcacattatgtgtttaaatcattctcctgactcttcagcaggaaacaattcttaaatttaggaaaatttaccaaagctaaggggaagggctttccatgccccctccccacctaaactctgattaaaagttagtgagttaatgtcacttaattacttgggtgcttcttttttgtcttgtctgtggctgcttaagtctgatggctcctacataacccagcgaactcgcacccgagctgacacacgatggaaatagaactgaataataattaacactattttccagtagggtaggacaattgttatttaaaacatagtccctatagctttatttaaacgtatctagttaaggttaatttggcatttaaagtagtaaatcaggaacattctcctaacttggattttcttgggaaatgcactaaacaggacaattattcctgaaaacctagtgaccttcacaggaacatggcgggacctgtgacactaagtaagcttcagtgaaaactgttcacggtcgtaaccgtagaagtgttgccaaatctgtttccatactctctttgatcatcatcaaacattctcaaatgtaggcaatgctaacactaattatagaaattaagaaaatgtgggctcctgtttgtaactaaacggacgtggggaggtgcacctcctgtcactgaggggtgcctttcatggacagtgatgctttgctttgaatggagagggcgaggaaccttgacttacagtgactatctaaggttgtgataaatatggcatttcaggtttttttcttggatttcccattaaaaatagtcttgtatcttgc

SEQ ID NO: 817 - DNA, 5563 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccacgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccaggaccccggca

SEQ ID NO: 818 - DNA, 4293 bp, Homo sapiens
gtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgccaaatactgaaatggaagcccgtcttacctggggtcactaactggttggttaactgagctaagaatagactgtgggtctcctcacttgtggcccagtgctctttctgctatacaaaatgtctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggttttggaatggta

SEQ ID NO: 819 - DNA, 4327 bp, Homo sapiens
cggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtatctatggctttttcaaccaggctttcttggtgttttttatcttggtttgtttgtttgaattcctcagcaacatctacagcaatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgccaaatactgaaatggaagcccgtcttacctggggtcactaactggttggttaactgagctaagaatagactgtgggtctcctcacttgtggcccagtgctctttctgctatacaaaatgtctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggttttggaatggt

SEQ ID NO: 820 - DNA, 2486 bp, Homo sapiens
acattatctctgagagcactcgcagatgctgagcctgcagagacagagaaactggcagctgaccagggtcagggatggtcatgtattcaaatattgtgggttttagtcaagtgtgctccacccgattcaacaatgtgatgtgactgctcctagcaactattttgatatggtgaatgttgttaagcataggacctaagaagaggtggcagtctctttcctctccgcacttggcaggccacccactcattcctgataatcacatttaagagagctctggacaagctggaatgcatccaagagaatccctcaacatgctggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccagttctaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatat

SEQ ID NO: 821 - DNA, 2480 bp, Homo sapiens
acattatctctgagagcactcgcagatgctgagcctgcagagacagagaaactggcagctgaccagggtcagggatggtcatgtattcaaatattgtgggttttagtcaagtgtgctccacccgattcaacaatgtgatgtgactgctcctagcaactattttgatatggtgaatgttgttaagcataggacctaagaagaggtggcagtctctttcctctccgcacttggcaggccacccactcattcctgataatcacatttaagagagctctggacaagctggaatgcatccaagagaatccctcaacatgctggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatat

SEQ ID NO: 822 - DNA, 826 bp, Homo sapiens
gacactcttgaaccatatctcaaatctgaagtctcctggcttcagtaaggcccttttatggggtccagacagtcctgaaccagcctgaagatgctagtggacatccccatttattactgctctgtgttaaagcatggaccaaggagtcttggaaaaaaaatcacaaggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatt

SEQ ID NO: 823 - DNA, 2743 bp, Homo sapiens
ctttctgattctcttctgatggactgctgctctgcttgtatatgtgtctttagtttggtgcctctcatcttttagttatgctgactctagaagtaagaactatgtgtacatagtataattttggaaaatatataaatgcaaagaagaaagcaaaaacaaaaaaacctcaatgagtcccactacttatgcatgctgttacaatctgagctcagtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgc

SEQ ID NO: 824 - DNA, 2659 bp, Homo sapiens
catttggcccggggatggtcacacgcgcgggggccggaactgccgtcgccggcgcggtcgttgtcgcattgctctcggccgcactcgcgctgtacgggccgccactggacgcagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaattt

SEQ ID NO: 825 - DNA, 1309 bp, Homo sapiens
aatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggatgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtggtgagtcagtggaccccctggagggtagatgcaagccctgttcgtcctgaagagggtgaaggacgagctccatgcttctgcccagcctgtccctgtggacacacctgcaagtaatcgctgtgcctctcccagcggatggcgcgtcttcccattaatgcgcttggattggatgaacgatggtgtagtgggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatggtaagtgtcccatcaatgttagtgcccagtacgactggaatttgtattactcctgcaaagctctcagaacccagtcttgggtggtcctccttcagcctgctctgatgaggtagaggatgggcactggagcaggcaccgtgtcagcacctgctcggaggactcactgcaggtgatatcctgggcatcctcccacctacatggcctttaacaggtgcctgggtgatccctttagacacgagagcatgagtctcatggcggatgggacagggctatctgtcgtcgtgtgtctgaggaagactttgctttttctctgtcttcctgtgttgtcatagctcagaggccctatggacagcgatgacagccatggatctgtgctaagactcagccaagccct

SEQ ID NO: 826 - DNA, 1308 bp, Homo sapiens
gcagctgggaatccggaatgctgcccgatggccctgggtcctcgctgtggggcaatccgggcttgcagacgagtgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactcca

SEQ ID NO: 827 - DNA, 1332 bp, Homo sapiens
agctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatca

SEQ ID NO: 828 - DNA, 1330 bp, Homo sapiens
aaaacgcttccaatggctgtgtttccggcgacggcgcgggggcagctgggaatccggaatgctgcccgatggccctgggtcctcgctgtggggcaatccgggcttgcagacgagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgt

SEQ ID NO: 829 - DNA, 3815 bp, Homo sapiens
atcccccccggaaacctttctctctccgtctctccctctaactcaaatctctcattcccgagtccaaactaagagagactcgcgccccaggagtcagccagcggcgcgggcgccttccccgcacgcctctgccgtctggaggacgcaggcgggagcgccccggaccgggttcacggtctcgcactcctgccgccggcgccccgcggtcccgccctagcaggctccttcccgggcccctccccgctccctcctctttctcgctgctcagtcacatctttctcttccttccaccccgagggaccatgtcgaggctcagctggggataccgcgagcacaacggtcctattcactggaaggaatttttccctattgctgatggtgatcagcaatctccaattgagattaaaaccaaagaagtgaaatatgactcttccctccgaccacttagtatcaagtatgacccaagctcagctaaaatcatcagcaacagcggccattccttcaatgttgactttgatgacacagagaacaaatcagttctgcgtggtggtcctctcactggaagctacaggttacggcaggttcaccttcactgggggtccgctgatgaccacggctccgagcacatagtagatggagtgagctatgctgcagagctccatgttgttcactggaattcagacaaataccccagctttgttgaggcagctcatgaaccagatggactggctgtcttgggagtgtttttacagattggtgaacctaattcccaactgcaaaagattactgacactttggattccattaaagaaaagggtaaacaaactcgattcacaaattttgacctattgtctctgcttccaccatcctgggactactggacatatcctggttctcttacagttccacctcttcttgagagtgtcacatggattgttttaaagcaacctataaacatcagctctcaacagctggccaaatttcgcagtctcctgtgcacagcggagggtgaagcagcagcttttctggtgagcaatcaccgcccaccacagcctctaaagggccgcaaagtgagagcctctttccattaaaaattgtcaccaatgaactcccccaaacatggctgtggagagacaacaaaacaaaacaaagcacaaaagtctctgccaacaactcttttgtggaattctaatttataggaaacattttagtatgagcttcagtgtcacaaagaaaaccagatctctctctcttttttttttattttttttagtgatagagtctcactctgtcacccaggctggagggcagtggtacagtcttggctaattgcagcctccaactcctggactcaagtgatcctcccacctcagcctccagagtaagtaggaccacaggcatgcacaagcatgcctggctaatttttaaattttttttttttaagaaatagggtcttgctatgttgcccaggctggtctcaagctcctgccctaaagtaggcctcctgcctttgcctctcaaagtgctgggatttcaggcatgggtcatcaagcccagctgacccagagctctttactaacttatctgtctcttatttgcactcatggatattcacagtaagcattgtttgacatatattaaaacccatgaaatatgtctacttcaacctgtgtgaaaatatagttaacattgcaaactttagaatgtattaaaaattttaccttgccatagagactgaattagtcacagctctcagtgatgttagatggaaacttatatctcaaatgataggattgtgatgctttttttgtaacaagtgattctgcttaatattttgttattccagttcataaaaagtagattacgttttcctataaggataatttttgcagtgattatattgctaactctcattgcatgatacctttaataaaatgaacaatataagagttaagggcaatgggataaagctacttaatgtgtctcctccactgatcaaaaatattccatatagtcttggtgaggaattccccaggatataaatggctatttacactgtaatgaattataccatatatgatattcactcagtaatgttaataatgaactggctaataattgacaagatgcagtgcctgccagtttatgacattaacttggtttgaaactaacatatgacatagtaccagtgcagtcagagctgcccttaggcatgatgaacatgtggcccgtttttgcctggtgttttggcagcaaagcaggaagcaattttgtgtgggtcattgttctgtcaatttgtggaaaaaattacttcagtctcatataaatatagaatgggtccataaacccttcaactcatttccatggcaaaactcacttttctttttatacatgtccttcagtctcttaattttgtcaggtggagcttgatcttaattttaacctattatcttttatttttgtttgtttttggtgaaggataagagtggtgtttcttttgccctttctggtacaaacagagggacactaagcattaacttaataatcacatttaagacttgaacacatgctacccttttgtcatcttctgacataagtttacctgagtttccttgatttggaagatttgtttcttttatctctcttcctctggatgtagtttttttttgttttttttttgtttttggacggagtcttagtctgtcactgaggctggagtacagtggcacgatcttggctcactgcaacctccatctcccgggttcaaatgattctcctgcctcagcctcttgagtggctgggattacaggcacatgccaccacacccggctaatttttgtatttttagtagagatgggttttgcaatgttggccaggctggtctcaaactcctgacctcaagtgatctgcctgcctcggcctctcaaattgctggaattacagttgtgagccaccacacctggcttgaatgtagattttaataattgaatttattctgccgtgttgatagaataactgaatatcagtaaattgtgtaacagtggtggatactgttgcataagatgagctcctgaagagtgaagctaattctttggtcaatgttcttttcccctcagtgtctagtttaaggcttttagaagattgatctgtagcaattatttaatgaattgaatatttaaaaaattttttatttgctgtctttggtaattatctctctgcttgaaattaaatgcactataagttaatataacaagtaaaatacattgtcttttgaaaatagtttctttttaaaggaatactaattaattgtaacttgtaaaaccaaaagttctaatggtttttaaaaaccagtgttgagtggaaaagtgtttctttagtttggaaagacctgtgaagtatcctagtcagggaaagaacctgttttctggaagaatgtaagttgctatatgtggaggggcatgtaggacaggggttctaattactgtctgtgagagttactactttgtaacttatggtttctgcttcagtattgtgttggttctgtattataaattgcaccttaatagaccaaaaatatctatacagcactgatttccttgaatattgtgtgttaattgatatatcttctagaggcaaaaggtttaaatgtgttaaaatggttatattgcctcctttttaaacaaattaaagagttgtaaatactagtgtagatctcttttgtttaccacagcaaatactgattttatgattgttaagcatttcatattttaatttaaattggattcaaccacaataaagaaaatgagaaaagcttt

SEQ ID NO: 830 - DNA, 1940 bp, Homo sapiens
tctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 831 - DNA, 2060 bp, Homo sapiens
atgtcatagaattctcaaaacttcctaactgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgagagatggaagctttgatgctcacaaggggctgccctggcaaacctcctgagagaaaagaaaagctaagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaac

SEQ ID NO: 832 - DNA, 2432 bp, Homo sapiens
tgtgccctgcgcccttgccccgcgccagcttctgcgcccgcagcccgcccggcgcccccggtgaccgtgaccctgccctgggcgcggggcggagcaggcatgtcccgcccggggaccgctaccccagcgctggccctggtgctcctggcagtgaccctggccggggtcggagcccagggcgcagccctcgaggaccctgattattacgggcaggagatctggagccgggagccctactacgcgcgcccggagcccgagctcgagaccttctctccgccgctgcctgcggggcccggggaggagtgggagcggcgcccgcaggagcccaggccgcccaagagggccaccaagcccaagaaagctcccaagagggagaagtcggctccggagccgcctccaccaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctcggaaaatgccacggtggctgccgagaccagagcagtcatagcctggatggaaaaaatcccttttgtgctgggcggcaacctgcagggcggcgagctggtggtggcgtacccctacgacctggtgcggtccccctggaagacgcaggaacacacccccacccccgacgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcagaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggca

SEQ ID NO: 833 - DNA, 2898 bp, Homo sapiens
ttggaaattcaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtacccctacgacctggtgcggtccccctggaagacgcaggaacacacccccacccccgacgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcagaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagaccctt

SEQ ID NO: 834 - DNA, 1462 bp, Homo sapiens
atgagtgatttactgagcatttactctgcgccagtcgtggtaagtactgtacttcacattactattgttttccctattttacaaataaggaaactgaggcttggcagagtccataaattgcccagggtcctggaggtaggaaacagtggaactatgtccagagcctatacttttttttttttgagatggaactcgatggcgctgactgggtacagctggctgctcctcagtgccacattcctgaatgtgggggccgagatctctatcaccctggagcctgcccagccgagcgaaggggacaacgtcacgctggtcgtccatgggctttcgggggaactgctcgcctacagctggtatgcggggcccacactcagcgtgtcatacctggtggccagctacatcgtgagcacaggcgatgagactcctggcccggcccacacggggcgggaggctgtgcgccccgatggcagcctggacatccagggcatcctgccccggcactcaggcacctacatcctgcagaccttcaacaggcagttgcagaccgaggtgggctacggacacgtgcaggtccatgagatcctggcccagcccacagtcttggccaacagcacagcgctggtggaacgtcgagacaccctgcgccttatgtgcagcagccccagccccaccgccgaggtccgctggttcttcaacggtggggccctgcccgtcgctctccgcctgggcctgtcccctgacggccgggtgctggccaggcatggcatccgccgggaggaggccggcgcctatcagtgtgaggtgtggaacccggtcagtgtcagccgcagcgagcccatcaacctgaccgtgtactttggcccagagcgtgtggccatcctccaggattccaccacccgcacaggctgcaccatcaaagttgacttcaacacgtccctcaccctgtggtgcgtgtccaggtcctgcccagagcccgagtatgtgtggaccttcaacgggcaggccctaaagaacggccaagaccacctcaacatcagcagcatgacagccgcccaggaggggacgtacacatgtattgcgaagaacaccaagaccctgctatctggatctgcctcagtcgtggtcaagctctctgctgcagcagttgccacgatgatcgtgcccgtgcccaccaagccaacggagggccaggacgtaacactgaccgtgcagggctaccccaaggacctgctggtctacgcctggtaccgcgggcctgcctccgagcccaaccggctgctcagccagctgccgtcaggaacctggattgcaggccccgcgcacacaggccgggaggtgggcttccccaactgctcgctgttggtgcagaagctgaacctcacagacactggccgctacacactcaagaccgtcacagtgcagggcaagactgagacactggaagtggagctgcaggtggccc

SEQ ID NO: 835 - DNA, 1701 bp, Homo sapiens
ctgcatcctcagcgcctagaacagcacctggcaaacaataggtgctcattcagtatttgtccaataagtgaatgagtgatttactgagcatttactctgcgccagtcgtggtaagtactgtcctgcggcagacggagccgagccccaaccaggaagggagtccgagcactgggacttcaacgccaccatctccaagactcggtttggggtgaaagatggcgctgactgggtacagctggctgctcctcagtgccacattcctgaatgtgggggccgagatctctatcaccctggagcctgcccagccgagcgaaggggacaacgtcacgctggtcgtccatgggctttcgggggaactgctcgcctacagctggtatgcggggcccacactcagcgtgtcatacctggtggccagctacatcgtgagcacaggcgatgagactcctggcccggcccacacggggcgggaggctgtgcgccccgatggcagcctggacatccagggcatcctgccccggcactcaggcacctacatcctgcagaccttcaacaggcagttgcagaccgaggtgggctacggacacgtgcaggtccatgagatcctggcccagcccacagtcttggccaacagcacagcgctggtggaacgtcgagacaccctgcgccttatgtgcagcagccccagccccaccgccgaggtccgctggttcttcaacggtggggccctgcccgtcgctctccgcctgggcctgtcccctgacggccgggtgctggccaggcatggcatccgccgggaggaggccggcgcctatcagtgtgaggtgtggaacccggtcagtgtcagccgcagcgagcccatcaacctgaccgtgtactttggcccagagcgtgtggccatcctccaggattccaccacccgcacaggctgcaccatcaaagttgacttcaacacgtccctcaccctgtggtgcgtgtccaggtcctgcccagagcccgagtatgtgtggaccttcaacgggcaggccctaaagaacggccaagaccacctcaacatcagcagcatgacagccgcccaggaggggacgtacacatgtattgcgaagaacaccaagaccctgctatctggatctgcctcagtcgtggtcaagctctctgctgcagcagttgccacgatgatcgtgcccgtgcccaccaagccaacggagggccaggacgtaacactgaccgtgcagggctaccccaaggacctgctggtctacgcctggtaccgcgggcctgcctccgagcccaaccggctgctcagccagctgccgtcaggaacctggattgcaggccccgcgcacacaggccgggaggtgggcttccccaactgctcgctgttggtgcagaagctgaacctcacagacactggccgctacacactcaagaccgtcacagtgcagggcaagactgagacactggaagtggagctgcaggtggcccccctggggtaacagcgtgaccctggagacgtccagagagaagagctcttcgcaccatcctctggtcctcgccctctgagtgggaaccactcccccacagcgaggatgccaggctgtggtcctgctgttctcctgcctccaccctagagctagagccacagggccccactccctcgctgagctgttggggagccaccgaggccataaacgtcctggttaa

SEQ ID NO: 836 - DNA, 1256 bp, Homo sapiens
gccccacccctgctggtcagagtgcaccctggggaggaaaggccgccctgaaggctgggagacgagaccggcagcctctgtgccaggagacacaggtcttggagggagcagaggaggtggctgtgtctctggagggacccctcctcctggaggaccccaggcagctcatggacctttccagacccagatggagcctgtggaggagggtcttcctcatggccagtctgctggcctgtgggatctgccaggcctctggccaaatcttcatcacccaaaccctggggatcaagggatatcggactgtcgtggccctggataaggtccctgaggatgttcaggaatacagctggtactggggtgcaaacgacagcgcaggaaacatgattatcagccacaaaccgcccagtgcccagcagcctgggcccatgtacactggcagggagagagtgaacagagaaggcagcctgttgatcaggccgactgcattaaatgacacgggaaactacactgttcgggtggttgcaggcaatgagacccaaagagcaaccggctggctggaggttctagagttgggaagcaatctgggcatctccgtcaatgccagctccctggtggagaacatggattctgtggctgctgactgcctcacaaatgtcaccaacatcacgtggtatgtgaatgatgtgcctacctctagtagtgaccggatgacaatttccccagacggcaagaccctcgtcatcctcagggtcagccgctatgacagaacaattcagtgcatgatagagagtttcccagagatctttcagagaagtgaacgcatctctctgactgtggcctatgggcccgactatgtgctgctgaggagcaatcctgatgatttcaacggcattgtgacagctgagatcggctcccaagtggaaatggagtgtatctgctattccttcctggatctcaagtaccactggatccacaatggctccctcctgaacttctcagatgcaaagatgaacctctcgagtcttgcctgggagcagatgggccgttaccgatgcactgtggagaaccccgtgacacagctgatcatgtacatggacgtcaggatccaggccccccatgagtgtcctcttccttcagggatcttacctgttgtccacagagatttctccatctcaggatccatggtgatgttcctcatcatgctgacagtgctgggtggcgtttacatctgtggagtcctgatccatgctctgatc

SEQ ID NO: 837 - DNA, 1197 bp, Homo sapiens
atggaggtgtctggctgccccacccctgctggtcagagtgcaccctggggaggaaaggccgccctgaaggctgggagacgagaccggcagcctctgtgccaggagacacaggtcttggagggagcagaggaggtggctgtgtctctggagggacccctcctcctggaggaccccaggcagctcatggacctttccagacccagatggagcctgtggaggagggtcttcctcatggccagtctgctggcctgtgggatctgccaggcctctggccaaatcttcatcacccaaaccctggggatcaagggatatcggactgtcgtggccctggataaggtccctgaggatgttcaggaatacagctggtactggggtgcaaacgacagcgcaggaaacatgattatcagccacaaaccgcccagtgcccagcagcctgggcccatgtacactggcagggagagagtgaacagagaaggcagcctgttgatcaggccgactgcattaaatgacacgggaaactacactgttcgggtggttgcaggcaatgagacccaaagagcaaccggctggctggaggttctagagttgggaagcaatctgggcatctccgtcaatgccagctccctggtggagaacatggattctgtggctgctgactgcctcacaaatgtcaccaacatcacgtggtatgtgaatgatgtgcctacctctagtagtgaccggatgacaatttccccagacggcaagaccctcgtcatcctcagggtcagccgctatgacagaacaattcagtgcatgatagagagtttcccagagatctttcagagaagtgaacgcatctctctgactgtggcctatgggcccgactatgtgctgctgaggagcaatcctgatgatttcaacggcattgtgacagctgagatcggctcccaagtggaaatggagtgtatctgctattccttcctggatctcaagtaccactggatccacaatggctccctcctgaacttctcagatgcaaagatgaacctctcgagtcttgcctgggagcagatgggccgttaccgatgcactgtggagaaccccgtgacacagctgatcatgtacatggacgtcaggatccaggccccccatgagtgcagcagctcccctccaggctcatgctttgcacatctccctgcctccatgccctgctag

SEQ ID NO: 838 - DNA, 1061 bp, Homo sapiens
ccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 839 - DNA, 613 bp, Homo sapiens
gtgtacacgccctgccaaaaaggaaggcgaaacatactttcagtttcagcccacacaagaagggtaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcaggtccgatacctggaaattagcttagtacacaagactcccaattactattttcttccttcccagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagtgaaagatatacttcaggcagttttgaaatgcagtggctttttcttaga

SEQ ID NO: 840 - DNA, 686 bp, Homo sapiens
gggtaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagtgaaagatatacttcaggcagttttgaaatgcagtggctttttcttagaaccaattttattgagcggttctggaggaacatacttctgctccccttgcataaaggatctctatatcctagaatcccaggtttaggtaaagagttgcaaactggaactcataaattatcatagtcttcacccagtctgtctcttagaatttatttcccactgacacaaacaagccattttgtctgcttgtataaccc

SEQ ID NO: 841 - DNA, 503 bp, Homo sapiens
gggaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcaggtccgatacctggaaattagcttagtacacaagactcccaattactattttcttccttcccagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagt

SEQ ID NO: 842 - DNA, 652 bp, Homo sapiens
atggctgaccaactcttgcgtaaaaagagaagaatttttatccattcagtgggtgcaggcacaataaatgccttgctggattgcctattagaggatgaagttattagccaggaagacatgaacaaagtgagagatgaaaatgacactgtcatggataaggctcgagtcttgattgaccttgttactggaaaaggacccaagtcttgctgcaaatttatcaagcatctctgtgaagaagaccctcaacttgcctcaaagatgggtttgcactaagagagaagatggaactctggagcacttcagagacttcccagagcttcttccaagggagaagatattctcgtgaaagaaaaaaacaaaacaaaacaacagtgcttttttcaaacctgattaatttcatcaatttccaataaatctttcattctctcatattactttcttcttattctttctctcctcataccaacagaggataattcatcaataataatgaaggtcatgatgattgtaatgtaattaagaaagtccctccctttcccttcctttctgtttagttcctttgcaatcctgtagagacatgtacagcttactttggtgcttttagcactgagagtctgctgtgatgggaataaaatgaagtcccagctcagaa

SEQ ID NO: 843 - DNA, 3961 bp, Homo sapiens
ctcgcctgtcttcaccgcggtccgctcggttcaccgcctgccccctctccctgccgcccggcccggctcgcccagtccagtggctccagtccggatctcgccgccgcccggcccaggtggtgctgatcctgggcacgtccatcctagacctcatcgagctacgcgcgcccttcggcaccacgggcttccgtctcaccatggcgctgtcggtgcccctgctctacagcttggtgcgggccatcagcgaggcgggcgcgcccccgggatcggcaggacccctgctgctgcagccccagcggcaccgcgcggccggatgcttcctgggcacgtgcttggacctgctcgacagcttcacgctggtggagctgatgctggagggccgcgtgccgctgcccgcgcacctgcgctacctgcttatcgccgtctacttcctcaccctcgcctcgccggtgctctggctctacgagctcaacgccgcggccgcagcggctgcatcctggggccaggcctccgggcctggcagctgcagccgccttctgcgcctgctgggcggctgcctggtggacgtgcccttgctggcgctgcgctgcctcctggtggtcagctaccagcagcccctctccatcttcatgctcaagaacctcttcttcctcggctgccggggcctggaggccctggagggctgctgggaccggggcaatcgggcctccccgagtcgggccagagggggctacggtgctccgccctccgcccctccaccacctccgccaccacctcagggaggctcccagctgggccactgcatctcggagaacgaggggggtgctcatggctatgtcaacaccctggctgtggcctctcagaattgagggtgaagggcacgggtccttgtttttgggttgagagtccccaacccccttgtcttctaccttctgtcacctagatttgatcagggtctatttggaagaggtaacccttttcagggctaagggccagggtgttcttctgcaccctggggtgaggacggcttggagggagaccagcagttaacggtgagggaggtaggtgcacttaccctctcctctcttctcctatcctaccccaatcctgacctccaaggggctggtacctctgcttcttgctttgcccacctccactctaattcccatccattaggaggagaggggtgctgggccttggaccttctcccttgcttagaagtgccagcctcttttaggctgtggttagtggccattgtcccatgccttgaaattgacccagaacccactttccactgatgtgtctcttggatttcttccaggtgatagatacaaagtgtatgtctctgtgtgtgtagtgttgttttctcgtgtccaccctgtggccctttgcaatgggtaggagatctggggaggccctgccccctacaccatacttatcaccaccctcctcttttctgcctggatttgtgaccatgaattcccaggaagagctgggcccctgggagctgcccaggtactccccttgaagggagaatctcacccaggatcttcctcaatactgctcctctcttctcagctcagggagaggaggggatccattctctaaggaccaaactgcaccctttcttgggtgagtgagcatttctacctccgtgctttcaacttttgttgcatcatgcactgatgctgcttgcaaaaaatgaagacaaaatactcagaagttgcatttgccatggccactggctccagctggggtttggtgccagtgttattacagggtctgcggagtatcagccattggcttggcctctctctgttcctccctctgcacctagaactcttatccttcctgtggtttggtgccgactgggtcggatctgggcttagagtaatagctttggtgggtttcctggatggatgtgaagttgggcctcccatgggcccaagggagtaggaagccccattccccacctgtccttcctctaggaagtgtagatcagaaagtgaggtggtgacctcccacctctggtctggttaagagtctcactagggccaaggcaggctgcagaactttccctcttcctctcattgagggtgatgacaagagacatccggggactgtgcacttacagtcggtgtggaatgtcactcttgcagtctttgaggcaggataagtatttttacatattttaagggtgcaggaggacagcagctaacaaggccaggaaatactcacttccctccaccctcaacaggatgtggtgggggtgaaacttgaagaatttttgtttccccttctcccttcttacgtttgggaagttttatgtagtgtaacaaactctagacgagttaccagaagatgtggattctagttctgattctgtcactcattggctttgagtgacatatttttatttcctgggcctgttttctcacattaaaaaagtagaagttagatgagtgatctctaaggttgaaggtaatttcagctctcacattcttttgagtttgtggctcttgaaagccctggtcctgatgctccctgtaaaggtggctgggagagaagccagccaggctgcacttgcagaacattccctgctctgtactgggtgtgtgaagccccagcagagaaggccggagggagggcttgggtgcctgggctgggtgtggggcagggcctggcacagctgcagagtgcacagggagggtcagaagtgccaagtcactggccgttaactcagcacccaggccaagcccccgcctcccacttgaagccccctcttacaactgttttgggggcttggagcagaagacacccttgtagacagacataagaggggcagaaggcttgaccagagttctcttgagcctcctcatgctctcagagcagggaacagcgggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatggccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaaccagactctgttctgaaaataaaaaacttgagacttgt

SEQ ID NO: 844 - DNA, 4954 bp, Homo sapiens
aggtgcgagtccccactgctggggaggcggcgggccccggctcccctcggccgcctagcccgcctcgcccgcccggggttggcggggagggaacagctgggcggccccagagcccctcggaggacaatgcgcccggcgctcggccaccctcgctcggtctcctccgcgtccggttccttcccgccgcccccggcagccgcccggctgcagcccctcttcctccgcgggggctccttccgcggccggagaggctccggcgacagcagcaccagcaccagcaccagccgcgggggaggcggcggcagacgcggcgggggcggcggctccccgagcagcagcacgggcgccgagcgcgaggacgacgacgagagcctcagcgtcagcaagccgctggtgcccaacgccgcgctcctggggccgccggctcaggtgggcgcccccgccggccccgcgcctgtcgccttctcctcctcagcggccacctcctcctccacctccacgcccacctcctcctgcagcatgacagccgcggacttcggcgggggcgccgcggccggggccgtcgggggccccgggagccgctcggcggggggcgcgggcggcaccgggaccggcagcggcgcctcctgctgcccgtgttgctgctgctgcggctgcccagaccgccccggccgcagaggtcggcgccgcggctgcgcccccagtcccaggtgccgctggggctaccaggcgctgtccgtggtgctgctgctggcgcagggcggcctgctggacctgtacctcatcgccgtcaccgacctgtactggtgctcctggatcgccactgacctggtggtggtggtgggctgggccatcttcttcgccaagaacagccggggccgtcggggcggcgcagccagcggcgcgcacaaccaccacctgcaccaccaccacgccgcgccgcccctgcatctgcccgccccctcggccgctaccgctggggccaaggcacgcggagcccgcgggggcgccggcggcgcggggggcggcctgggggcggccgcggcagcgggcgagttcgccttcgcctacctggcctggcttatctactccatcgccttcactcccaaggtggtgctgatcctgggcacgtccatcctagacctcatcgagctacgcgcgcccttcggcaccacgggcttccgtctcaccatggcgctgtcggtgcccctgctctacagcttggtgcgggccatcagcgaggcgggcgcgcccccgggatcggcaggacccctgctgctgcagccccagcggcaccgcgcggccggatgcttcctgggcacgtgcttggacctgctcgacagcttcacgctggtggagctgatgctggagggccgcgtgccgctgcccgcgcacctgcgctacctgcttatcgccgtctacttcctcaccctcgcctcgccggtgctctggctctacgagctcaacgccgcggccgcagcggctgcatcctggggccaggcctccgggcctggcagctgcagccgccttctgcgcctgctgggcggctgcctggtggacgtgcccttgctggcgctgcgctgcctcctggtggtcagctaccagcagcccctctccatcttcatgctcaagaacctcttcttcctcggctgccggggcctggaggccctggagggctgctgggaccggggcaatcgggcctccccgagtcgggccagagggggctacggtgctccgccctccgcccctccaccacctccgccaccacctcagggaggctcccagctgggccactgcatctcggagaacgaggggggtgctcatggctatgtcaacaccctggctgtggcctctcagaattgagggtgaagggcacgggtccttgtttttgggttgagagtccccaacccccttgtcttctaccttctgtcacctagatttgatcagggtctatttggaagaggtaacccttttcagggctaagggccagggtgttcttctgcaccctggggtgaggacggcttggagggagaccagcagttaacggtgagggaggtaggtgcacttaccctctcctctcttctcctatcctaccccaatcctgacctccaaggggctggtacctctgcttcttgctttgcccacctccactctaattcccatccattaggaggagaggggtgctgggccttggaccttctcccttgcttagaagtgccagcctcttttaggctgtggttagtggccattgtcccatgccttgaaattgacccagaacccactttccactgatgtgtctcttggatttcttccaggtgatagatacaaagtgtatgtctctgtgtgtgtagtgttgttttctcgtgtccaccctgtggccctttgcaatgggtaggagatctggggaggccctgccccctacaccatacttatcaccaccctcctcttttctgcctggatttgtgaccatgaattcccaggaagagctgggcccctgggagctgcccaggtactccccttgaagggagaatctcacccaggatcttcctcaatactgctcctctcttctcagctcagggagaggaggggatccattctctaaggaccaaactgcaccctttcttgggtgagtgagcatttctacctccgtgctttcaacttttgttgcatcatgcactgatgctgcttgcaaaaaatgaagacaaaatactcagaagttgcatttgccatggccactggctccagctggggtttggtgccagtgttattacagggtctgcggagtatcagccattggcttggcctctctctgttcctccctctgcacctagaactcttatccttcctgtggtttggtgccgactgggtcggatctgggcttagagtaatagctttggtgggtttcctggatggatgtgaagttgggcctcccatgggcccaagggagtaggaagccccattccccacctgtccttcctctaggaagtgtagatcagaaagtgaggtggtgacctcccacctctggtctggttaagagtctcactagggccaaggcaggctgcagaactttccctcttcctctcattgagggtgatgacaagagacatccggggactgtgcacttacagtcggtgtggaatgtcactcttgcagtctttgaggcaggataagtatttttacatattttaagggtgcaggaggacagcagctaacaaggccaggaaatactcacttccctccaccctcaacaggatgtggtgggggtgaaacttgaagaatttttgtttccccttctcccttcttacgtttgggaagttttatgtagtgtaacaaactctagacgagttaccagaagatgtggattctagttctgattctgtcactcattggctttgagtgacatatttttatttcctgggcctgttttctcacattaaaaaagtagaagttagatgagtgatctctaaggttgaaggtaatttcagctctcacattcttttgagtttgtggctcttgaaagccctggtcctgatgctccctgtaaaggtggctgggagagaagccagccaggctgcacttgcagaacattccctgctctgtactgggtgtgtgaagccccagcagagaaggccggagggagggcttgggtgcctgggctgggtgtggggcagggcctggcacagctgcagagtgcacagggagggtcagaagtgccaagtcactggccgttaactcagcacccaggccaagcccccgcctcccacttgaagccccctcttacaactgttttgggggcttggagcagaagacacccttgtagacagacataagaggggcagaaggcttgaccagagttctcttgagcctcctcatgctctcagagcagggaacagcgggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatggccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaaccagactctgttctgaaaataaaaaacttgagacttg

SEQ ID NO: 845 - DNA, 2852 bp, Homo sapiens
gaagagaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 846 - DNA, 2852 bp, Homo sapiens; identical to SEQ ID NO: 845

SEQ ID NO: 847 - DNA, 2852 bp, Homo sapiens; identical to SEQ ID NO: 845

SEQ ID NO: 848 - DNA, 2852 bp, Homo sapiens; identical to SEQ ID NO: 845

SEQ ID NO: 849 - DNA, 2852 bp, Homo sapiens; identical to SEQ ID NO: 845

SEQ ID NO: 850 - DNA, 2852 bp, Homo sapiens; identical to SEQ ID NO: 845

SEQ ID NO: 851 - DNA, 2852 bp, Homo sapiens; identical to SEQ ID NO: 845

SEQ ID NO: 852 - DNA, 2129 bp, Homo sapiens
agagctccaggcgcacatccgcagtcagccacctcgcgcgcgcctccaggagcaaggatggagaggctggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaatattgaacaattaaaagtgttgactccaaa

SEQ ID NO: 853 - DNA, 1524 bp, Homo sapiens
agagctccaggcgcacatccgcagtcagccacctcgcgcgcgcctccaggagcaaggatggagaggctgactctgaccaggacaattgggggccctctccttacagctacactcctaggaaagaccaccatcaatgattaccaggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagtt

SEQ ID NO: 854 - DNA, 3114 bp, Homo sapiens
gtttggggccggcccaggcctagggtgtggaggagccttgccatcgggcttcctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgtcctcaccggtttcagaagacatgtagccccatttgaggcacgaggccaggcagatcccacttgcagcctccccaggtgtctgccccgcgtttcctgcctgcggaccagatgaatgtagcagatccccagcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccagtcaaggatggatgcagatccagaggtttctggcagccagtacctcctgccccatgctgcccgcttctcaccctatgtgggtgggaccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagcgcaagctgggagcacaggcactgcaggagagaatgcccagtgaccagtcactgaccctgtgcagaacctcctggaagcgagctttgctgggagagggggtagctagcctgagagggaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagat

SEQ ID NO: 855 - DNA, 3604 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagcag

SEQ ID NO: 856 - DNA, 3785 bp, Homo sapiens
agtctgaggatggccgcggccgcggccggtggagccccgggcccggcccccggccccgccgggcccccgccacccgccgcgccgacctcggccgctcgggccccgccgcaggcgctgcggaggcgcggggactcgcggcgccgccaggccgcgcttttcttcctcaacaacatctccctggacgggcggcccccgagcctgggcccgggcggagagaagcccccgccgccgcccgccgaggcccgcgaaccgccagcgccgccgccgccggagccccccaccgggctgcccgccaggacccccgcgccccagggcctgctcagccccacgcaggtgcccaccggcctcggcctggatgggcagcgccagaggaagcgagtcacgtcccagcgctgctccctggagtttctggaagatgccgtgggatgcgctccagcacagagaaccaaacacacatctggatcaccgagacataaaggcctgaagaagacccacttcatcaagaacatgaggcagtacgacaccaggaacagcaggatcgtgctcatctgtgccaagcggtccctgtgcgcggccttctcggtcctgccctatggggaaggcctgcggatcagtgacctgagggtggacagccagaagcagaggcacccgtccggcggcgtctctgtgtcttccgagatggtctttgagctagaaggtgtggagctaggagcagacgggaaggtcgtgtcttatgcgaagttcctgtatcccaccaacgccctggtcacacacaagagtgacagccatggcctgctgcccacacctcggcccagtgtcccccggactctgccagggtcaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgacgcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcagcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttcctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaactacagtctcagcctgtcattctctagaacacatccaggtgtcggagctaaggtgttcagctcggctgtgactatacagaaccaggcctggcgttgcttccgcaccggtagcagttgtggatgtcagtgtgcataagcaagtatcagacctcagaatgtttgagttattttgtcttagatatctgtttttaaatggataatgtatttgtcctttaaacctcagttttgcaata

SEQ ID NO: 857 - DNA, 3676 bp, Homo sapiens
tctgaggatggccgcggccgcggccggtggagccccgggcccggcccccggccccgccgggcccccgccacccgccgcgccgacctcggccgctcgggccccgccgcaggcgctgcggaggcgcggggactcgcggcgccgccaggccgcgcttttcttcctcaacaacatctccctggacgggcggcccccgagcctgggcccgggcggagagaagcccccgccgccgcccgccgaggcccgcgaaccgccagcgccgccgccgccggagccccccaccgggctgcccgccaggacccccgcgccccagggcctgctcagccccacgcaggtgcccaccggcctcggcctggatgggcagcgccagaggaagcgagtcacgtcccagcgctgctccctggagtttctggaagatgccgtgggatgcgctccagcacagagaaccaaacacacatctggatcaccgagacataaaggcctgaagaagacccacttcatcaagaacatgaggcagtacgacaccaggaacagcaggatcgtgctcatctgtgccaagcggtccctgtgcgcggccttctcggtcctgccctatggggaaggcctgcggatcaggtcgtgtcttatgcgaagttcctgtatcccaccaacgccctggtcacacacaagagtgacagccatggcctgctgcccacacctcggcccagtgtcccccggactctgccagggtcaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgacgcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcagcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttcctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaactacagtctcagcctgtcattctctagaacacatccaggtgtcggagctaaggtgttcagctcggctgtgactatacagaaccaggcctggcgttgcttccgcaccggtagcagttgtggatgtcagtgtgcataagcaagtatcagacctcagaatgtttgagttattttgtcttagatatctgtttttaaatggataatgtatttgtcctttaaacctcagttttgcaatatg

SEQ ID NO: 858 - DNA, 775 bp, Homo sapiens
gacaccaggaacagcaggatcgtgctcatctgtgccaagcggtccctgtgcgcggccttctcggtcctgccctatggggaaggcctgcggatcaggtcgtgtcttatgcgaagttcctgtatcccaccaacgccctggtcacacacaagagtgacagccatggcctgctgcccacacctcggcccagtgtcccccggactctgccagggtcaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgacgcagctcatcgataagttagaagaaaggtttcgattcaacaggcgcgacctgatagggtttgagttcacagtgctcgtggccttggagctggccctgtatcttcccgagaa

SEQ ID NO: 859 - DNA, 800 bp, Homo sapiens
atccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagcccacggggtcctaagtaggaaccagcttcacctctctgctttccctcttatgaaaatggccgatgcctttttgtgaaggtctcaaagcccacttcatcctggctgcagcaccaaaaggacaaaggcccgcttttgaagtgcctgataaggcattcctttcacccctccatgaggaaggtggcaaatcttgagactccctattagagagcttcgattttcctgaaattgtgttaggaaaatagggtgacttggtttgatcttggtttctatacctattatggctgcctgactctggtcatttggcccctgcaggcctaagccacttggttttgcttcacatattggggtttattagaacagtacgtagggaagcaatgccagaggcacccgtcccttttccctgccttctaggtgctcctgggaaatcctggttttccatggttaggcaaatgtcagagaattggggaaataaataatgtttttgttagactaacattccatgtatttaaaaaataaaaatattttggtcctca

SEQ ID NO: 860 - DNA, 1223 bp, Homo sapiens
cgggaaggcggcgggctatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaaggtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctctcttaagactcctggtattaccaacataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggtttttttttttcttatcgacaaggtctcactctgtcgcccaggcagaagcacaaaggtgcagtattggctcattgcagcctcgaactcctgggctcatattttcagggttttttgttttttgttttgtttttttgagacagagtcttgctctgttgcccaggcagtagtgcagtggcgcgatatattttcagtttttaaacgtcagaatttttgtttaaaatgcctttttgggctgggcacagtggcttatgcccataataatcccagcactttgggaggccgaggtgagcagatcacctgaggttaggagtttgagaccagcctggccaacacgatgaaaccccgtctctactaaaaatacaaacaaaattagctgggcatggtggcggacatctgtaatcccagctactcaggaggctgaagcagaagaactgcttgaacctgggaggtggaggttgcagtgagccaagatcgcaccattgcactccatcctgggcgacaaaaatgaaacaccgtctcaaaaaaaataaaaataataaaataaaa

SEQ ID NO: 861 - DNA, 2420 bp, Homo sapiens
taatcatgtcactattttgtcctgaataattaagagtttgcttttttcccatgtctttgcaataggataatataaagaatagtattaaaagtcagaggctttactaatctacctatatgtattccatggctaacaaaccctggcccctttacatatgagctctggaggttcgcctggctgcctcaggcttgcagaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctgtacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctct

SEQ ID NO: 862 - DNA, 1796 bp, Homo sapiens
gcactcgcaggtcgagcgggcgtcgtccacccttcggagccccgctttcatgcgtgaaattcccagaagtcgcctgcgaccgcctccctgcttcaaacaccagagagggcccggggtcctggccggagacaggccgaacctccggagctgcttctgcacccggtacattgatcgatctgatgggctgcgcgcccggaagagctggagagatgaagccagcgtccagcttctcccccaaaccacagcacgccgagctttgtccccggggagcgtgaagtcaccagctccgggaggcgacaatatgagggcgatggacggggcagggacccccggaagccccagcaatcctcagggaagtgggggtgccggaggagtcggggacaccctcaggcctctccaagcccggagcatccccagcgcccgcagccctgtgagacgccgggtgctctggtaatgggccctgccgccaggcctcggcgctttgtccccggcccgcccggggatgctaccacgctagagttgtacaccaaggtttgtcttcccaggaagcgctggcggctgcctttgggccgcctggcgcggagccccaggctgcaggcgccgcgtgtgcgggcgggaagttcccacagttgcaaagaggcagcgaagtatgtgttccaaactttccacggttccaaactgagcgcttccattaagagaagcggtgtgcgggggaaaagcattctgggtattagcatgcaaatgaacgggcccggcttccaactccgctcgggattcccaccgctgcgcgccgagctcgcgcccagccacgcgcgccctgaggcttccgggcgttgccctggcggatgatccgagttcaaaatcgagacctctgccttctggtttcgtgtcctggtgcttagtcacttggcctccctgagattcagttaaactgtttcttaacctgtgcacagggacagcagcacctgtcctgcacacctccgctctagggcatagtacatgccaaactcctgttggagagaatgaattagaggcatgaagaaagttccctggacacgaagccaggagatctgtgttctaagcccagactcactgtcaccttaggctagtgcctccctctctgagccacagctttcttgggcggattttgggaactggcacgttttatttttgagagagctgctgggaacatccacagagaaagagaaaggggccgggcgcggtggctcacgcctgttatcccagcactttgggaggctgaggcgggcggatcacctgaggtcgggagttcgagaccagtctgaccaacacggagaaaccccatctctactaaaaatacaaaactaggccgggcgcagtggctcatgcctgtaatcccagcactttgggaggtcgaggcaggcggatcacctgaggtcgggagttctagaccagcctgaccaacatggagaaaccccgtctctactaaaaatacaaaattagccgggcgtggtggcacatgcctgtaatctcagctactagagaggctgaggcaggagaatcgcttgaacctgggaggcggaggttgccgtgagccgagatcgtgccattgcactacagcctgggcaacaagagcgaaactccgtctcaaaaaaaaaaaaaatacaaaattagccgggcgtggtggcacatgcctataatccgagctactggggaggctgaggcaggagaatcacttgaacccgggaggcggagttgcggtgagccgagatcgcgccattgcactctagcctgggcaacaagagcaaaactgtttc

SEQ ID NO: 863 - DNA, 1582 bp, Homo sapiens
gacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaattt

SEQ ID NO: 864 - DNA, 1583 bp, Homo sapiens
ctgcaaaagggaccagagtataatgccaatgaaaagaaacaaaggatttcccagaagaggcggtagtttttttcagttgcctcagcgttttggtcacctttggggttaaagtcttctgcagagaatgcttcaagaagccttaacagaagccagttttctcaagctggtcattttctttttctttttttcttttttgagacggagtctggctctgtcgcccaggctggagtgcagtggtgcgatctcggctcactgcaacctccgcctcctgggttcaagctattctcttgcctcagcctcccgagtatctgggattacaggctcccgccaccacgcccagctattttttgtatttttagtagagacggggtttcaccatattggccaggctggtctggaactcctgacctcaggtgatccacccacctctgcctcccaaagtgtggggatcacaggcgtgagccaccgcgcccagcagatgagaatcattttcattttcataaaattgtgaatcttgacagccctatcccctcttttaaaatccgtttgtttacatacagcctagcatttggcaaaagtacacatcttaaggggtatgtagaaggagcggtagcttcttgcttatttttcttaaactgcatcaatatttggcagcatgattggtacctagttgctatttaacattggttagaattaacataaatgctaatacaaatttaaaatggagttattcttcttgggataaagtgtggcataaaataccttggatgaagtaatacgtgagtactgtctcgctacataccagtttcaagcaatttgttttcaagaatagcaagtgtttatttgtggtagatgttttaagataatatcctcccaccatcagcaaatgaaatcaaacataccacttttcaaatgattagcgagtaacatgctgttaaagttgtctcccatctcatttgtcataaattcttaacattgtgcaatccatctagctcaaatgtttaaaaataagtccaactgagtttttccccttttctcatgtttagcaaaatagaaaaactcttaattttcaggttcagatactttgtgaccctatttggtggcttgtaactggctccaattccctaattctcagtgacatgtgtttctgctggttccaggaggtaaactgcagttttaacagatcatgggataatgagactgggagtacctgggggaggctggggagaggcaatgggaaggagacaaagagagggaaggttgatgggcagagcgaggatttatagtggcaccagatttgcaataaaatctgtttaaagttattgcttccgtttgatatattttcccacatcatcaacttcaattaaatttattttaaaaatcagtctttcagatatagggctagtattataaacatagaatatgataaaagtgctccttgttagggtgccataatgtaaaatactgtgaaaattcttaacgaaatgttttttacttaatttattcacttagtcaacaaatgtttattgagaacgtattatatataaggcaagatgaataaatccagatttctgttctgaatg

SEQ ID NO: 865 - DNA, 2387 bp, Homo sapiens
ttcctccgcgcgggattttcggcgtccctcagccagctggtctcaaacgctcacgcgctcgttggctccctttagtcgcaagcctggaagttggtgactgtagacacagggcccacgggcttcgtgctgtgaccgtgagcaggtcatttggatctcagagtttgtgtcttccgctgtaaaatgagacgcctggactcggtggcgctttccgcacagttcgggggacggggacggggcctggttgtctggtgaggcttctgcgcgcctctgtcccgctgcgctccttccacaatggcggcttgtcttctttctactttcgtgcactaattctttggttttagctcttaataagaatggcaggtccctggactaaatgcttacagggcaacttcctgctgtataagtccttgattctgtttttcttctcgctttccttttttgttcgtaaacctaaagaaaggaatttaagtccagcatttcccactcttcgctttttgctgttctttcctccgagagagaaaaagaaaatcctacacgtacagcctttaaagttcctctttcctctcctgcattatttctcattatctgccgcaagataattttctttttttggtacttgacactggctttgaacggacaactttttttttttttaatgagtggaaatattcatttattcagcacttagaaataacagttcttgataatattatgatttataatttatacatggtgtattttaatgaattgcaggtgtttaagaaataagtaatatagcagggcgcggtggctcatgcttgtaatccctcacgcctacaatccctcacgcctgtaatctcagcagtttgggaggccgaggtggacagattgcttgcggtaaggagtttgagaccagcgtaggcaacatggcgaaaccccatctctacgaaaaattagccaggcatagtggtgagtgcctgtagtcccagctacttcggaggtggaggccgaagaattgcttgagcctggaaggctgagatctcagtgagccgagactgccactgcacgggtgacagagcgagcctctgtctcaaagaaagaaagagtatgtacctggatatgtatttttatttttatttttattttttacagcttaacgagatttttttattttcctgactttttgctttggagaattagtcagtagttaaggtctatcttgttcgtttactatggggtttgaatttgagatggggctgacgtcactttggggcccttttcttttcttcttttttttttttttttttattgatcattcttgggtgtttctcgcagagggggatttggcagggtcataggacaatagtggagggaaggtcagcagataaacaagtgaacaaaggtctctggttttcctaggcagaggaccctgtggccttccgcagtgtttgtgtccctgggtacttgagattagggagtggtgatgactcttaaggagcatgctgccttcaagcatctgtttaacaaagcccatcttgcaccgcccttaatccatttaaccctgagtggacacagcacatgtttcagagagcaccgggttgggggcaaggtcatagatcaacagcatcccaaggcagaagaatctttcctagtacagaacaaaatggagtctcctatgtctacttttttctactcaagacacggcaacaatctgatttctctatcttttccccacatttcccccttttctattccacaaaaccgccattgtcatcatggcctgttctcaatgagctgttgggtacgcctcccagacggggtggcggccgggcagaggggctcctcgcttcccagaaggggcggccgggcagaggcgcccccgacctcccggacggggaggcggccgggcggaggcgctcctcacttcccagacagggtggctgccgggcgcaggggctcctcacttctcagacggggcggctgctgggcggaggggctcctcacttctcagacggggcggccgggtagagacgctcctcacctcccagacggggtcgcggccgggcagaggtgctcctgacttcccagactgggcaggcgggcagaggggctcctcacatcccagacgatgggcggccaggcagaaacactcctcacttcccagacggggtggcggccgggcagaggctgcaatcttggcactttgggaggccaagggaggcggctgggaggtggaggttatagctagccgtgatcatgccactgcactccagcctgggcaacattgagcactgagtgaacgagactccgtctgcaatcccggcacctcgggaggccgaggctggcagatcactcgcggttaggagctggagatcagcccagccaacacgtgaaaccccgtctccacc

SEQ ID NO: 866 - DNA, 1917 bp, Homo sapiens
tttccctaaagaatggcccttgtggataagcgctaagtcaagagacagtgattggacagaatttgtgaggaattcgcccccagatcatgaaagtcaccctgaaccccgcctcgtggtggctctgctggatggacgggactgcactgtggacatgcccatcctgaaggacctggccacctggccttctgtgaggctcagtccatgcaggagatccacgagaaagttctaaacgaagtcgtgggcgccatgatgtaccacaccttctccctcaccagggaagacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaacaggtcgctgtaccaggcactgagggaaggcacgcgagttcagagcgtggagcagattggcgaggtggcctcagtaaaggctcgcattcgtggggagatattgggcctcatcggcttcggtcgcacgcagcaggaggttgcagttcgagccaaggcctttgcaggatgggatcgagcggtccctgggtgtgcatagggtctacacccagcaggatttgctgtatcagaacgactgcgtcttcttgcattgcaatctcaacgaacaaaactaccaccttatccatgactttactataaagcagatgaggcagggagcattccttgtgaacgcagcccgtggtggcctggtggacgagaaagcctgagcacacatcctcaaggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggtccgtaataaaccagcaagaaattcatcctgagctcagtggtgctacctacagatatctgccaggcatggtgggcgtggctccaggaggacttctgcagccagggaagacatcatccctggagacatcccagtgactgacaacctcccaacagtggtacatccttcccaagggccctctcccaacagcccacaaaacacggggacagtcgagagcatcccaacgagcaatagcagagaatgccggaaggtaattattcagatatacttgggaacagtgaaaaatagataatctaagagaaaaagaatctgacggcctttttagctgattccggacatatgcatcattgttgttgcagtgttaaaacaagagctagaaaactgacaatgtcgtctgcttacggaagctctgaaagactagggtgtgatttattaacgcccaacttctattattgtgtgttaagtttttcatctgtgcatcaaatcacaaagaataaatagaacttttccctttatcagtcccttaggcacagcaggtcctgaacaccctgcttatatgttgcatcagcagttcaaatatgaaaataaaaaccatgaagaggaaatccgcatcctgtgactggagtcccttcagtctacagggactggttaccgctttttgctaataggaagattacattactagaaaatgtggagtaaactgtttgcctgtggtaaacacctgcatgcaaaggattgaagacagtaccggctcctgtacagagacgcgtctctcacatctgagctgcatattgagcggcaagttggttgtaagttcagtaaaagccgctgatgatgc

SEQ ID NO: 867 - DNA, 2665 bp, Homo sapiens
tgtggtggtatgcgcctgtagtcccagctactttggaggctgaggtgggagtattgcttgagccaaggaggtcgaggctacagtgagctgtgattgagccactgcactccaatctgtgtgacagagcaagaccctgtctcaaaataataataataaaatcaaaaagagtgttaagggggtctccacttaaggagtagagagtccggggcagttctcgtatctctgtccttgtctcattttagatgtttagatatttagatattatacaaggccacccagtggtaaccaacctagaatgtgttggcctcctcttcccctcactccgtgtaggttctgtgcagcctggctgctggtggcatctcttatcatgggacattggtggggacccagccgtgcccttggtgccaagaagcctaaagggctcctgtcgcctggaaacttgagagtgcagggtcgggtgctgtgccccacaaggtgctgagcaagcccaagaagaagagtgtggggtgtggtgtgtgagttcagacctcttggagctgtgggggcatggttcccatcagctgctgttcctctgatgatgcccactgcgtgttgtgggaggcgtggccaccgtgtgatgttgtagtaggagaagggagacttaggagctagacatgatacgcaggcatcaagaggtcaaccaggtgtccacaatctgtgagccacacagagctctctttgtgcatatgcatcccaagcttcaggaaggcaacagctactagagggcctgaggacagattcttggtcgcagaagcggcattggctttagttcagccctcaccatgtttaccaacgtcacttctgtgttcccctcatgggtctcccagctcccagtctccatgccacctccacgctgagaccagaccagttttccccacacacaaatccaagcctgtcactcccctgcttgaaatccttccctgtctccctgtggccttggggtagggcctctctgctctgccacctctccagactttttgtatgccaccgcccactcacacccacctctcaggctccaaacatgttctcttgcgtcagctcatcccttacactcgctgcttcctctgcctggccagcctcccaccttccgatctcccactcaccttttttgcctcctcatcttttgaggtctcagctcagtgtcacttcctcccgggagcctcgcctgtctcttccactccagcttggtcagtgagcagagaggcttgtgtgcttttctgtcgctgtacccataagtgtcatctgcatgtgagcatgagggccggcccattgtacccctaacaggggaggatgctcagcacttcctggatgtcgaatacctgagcgataaacaactaatgttcaggaagtgctttccaggtggcaaaaggtgtttcctctactttgaagcaagaatcttcaccaatatacatgctattttattaccccaatttactgatgaggaaactaagcttctgagacttcaagcgattttccaaggtcatgtagggatacacaagttccagcatgtgattgtggtaaaggttgtgtgtgacacatgagtgcaaccagagatgtgtataaagattgttactgggccgggcgcggtggctcacacctgtaatcccagcactttgggaggccgaggcaggtggatcacgaggtcaggagattgagaccatcctggctaacacggtgaaaccccgtctgtactaaaaatacaaaaaattagccaggcgtggcatgcgcctatagtcccagctactcgggaggctgaggcaggagaatggtgtgaacccgggaggcggagcttgcagggagccaagattgtgccactgcgctccagcctgggcgacagagcgagactccatcttaaaaaaaataataaaaggattgttattgatgaccaggtgcggtggctcatgcctgtaatcccaacactttgggaggctgaggtgggcagatcacctgaggtcaggagtttgagaccatgctggccaacatggtgaaaccctgtctctactacagatagaaaaattagctgggcatggtggtgcgcacctgtaatcccagctacttgggaggctgaggcaggagaattgcttaaacccaggaggcggaggttgcagtgagcccagatggcaccactgcactccagcctgggtgacagagcgagactcagtgccccccaaaaaaagatttttattgctgcattctctgaaatagcaaggaattaaaaactgcctgtagatacagcaattaaagtgaactccatccgcatgtaccaatatagacgaagtcctaaaaacataataactaagtgaaatgtacattgtgaaaggatagctacagtgagatacctgtacttggaaactgtaaaaacccaaaataatgctaaatgctcaggaagagacagagacacaccagcttcaaggatagtggtggcctgtggtgataggtggaagggaatgggatggggtgatggggtttttagccatatctgtatttgtattttactataaaaatacttgacataaacatgacaaaatatgaacccctggtaaatctgggcaatgagttccccaatgtctactatattattttctacctttttctgtttttcaaatagttccataattaaacattt

SEQ ID NO: 868 - DNA, 2946 bp, Homo sapiens
agcggcggtgggaggagtgggggacctggagggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcagtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaaggccatggattggtgtccctggcagtctggggtccttgccattggaggaggaatgaaggatggacgcttacacatcttggatataaatgctgggaagagcatccagaccccaagcacaaactcacagatttgttccttaatctggctacctaagacaaaggagattgcaactggtcaaggtactcccaagaatgatgtgactgtgtggacctgtcccactgtgtccaggtcaggccacaggggcagagtgctgcacctgtctttgagtccagaccagacccgggtgttttctgctgcagctgatgggacggcctctgtatggaattgctactagcacccagcccctctaggtttcagtttccttatttctgagtgaagatgatgatgttggctatgtcttctccatggggtttttatgagtatcaaacaagttgaaatactcttcttgatgtgaatgcctgttctcctgttcttcttttgcagattgctttacttgctctgcttcccagagatccgcttcttttcttctctgctttcttctttctgcccctcttcctccccctcctcttcttcctcccattcttacccctttctagagattcattttcactactttattcagaataacatctatagcaaagatttctacttctttcccgtatgacttttctccccagctccaaacctcatatttctgattgcctcaggatagttcccttttgagatactttcctgtctttagctcaatctcaacacattgaaaacacaactcattcacttgaaaaacacttactaaaatctcactatatgctaggcagtatgttaagcatgcatattgctctctctaaaaatcagttctgtaggaatccctttcccctcctgatggtctcatccttatcctggtctcccactcagggaacctcctgattattctgctctgtgcttcctcagttcaccctttgctctcttttcttttgcttcacctagtcacatcctgtgtgcctgacagccagtctgctgtaattgtcttagaactgatcctcttgactccacaccactgctaggttgaacatctaaaagtcctgtgctgatcctctcagtcccctgctcatcaactctcaaggacaacctattaccaaacacctttgacctcaacctctggagtcctcagcccaggacttgaagttaggagatctttttttgccttggctctgccataaatacaccctgtaaccttggatgtgttgcaacatctgcaaggataggaatttgatcactgctaaggttccttcaaacttgatcagttcgctgttctgtcttttgaatgttaattcacattcatctcctatattaagactttggctaagtcttgtgatttcttgccttattggagcttttcttctaatctgaattcttgcttctctctccttttcctttacacacccacacaagtcctaacctctccaggaagtgttttgaaatgatgttacctgggtttgagttcttggcattagcctgtatcatctatttggtattattatactattatagctgttt

SEQ ID NO: 869 - DNA, 1679 bp, Homo sapiens
agcggcggtgggaggagtgggggacctggagggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcagtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaagatttgttccttaatctggctacctaagacaaaggagattgcaactggtcaaggtactcccaagaatgatgtgactgtgtggacctgtcccactgtgtccaggtcaggtgggttttttggccacaggggcagagtgctgcacctgtctttgagtccagaccagacccgggtgttttctgctgcagctgatgggacggcctctgtatggaattgctactagcacccagcccctctaggtttcagtttccttatttctgagtgaagatgatgatgttggctatgtcttctcc

SEQ ID NO: 870 - DNA, 756 bp, Homo sapiens
gcagcggcggtgggaggagtgggggacctggagggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaagatcactttagtggcagcatgaagaaacgatttgaacaggaggatgttggtggcaaagactaa

SEQ ID NO: 871 - DNA, 3070 bp, Homo sapiens
gcagcggcggtgggaggagtgggggacctggagggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcaggctggagttcagtggcgtgatctcagctcactgcaacctccacctcccgagtagctgggactacaggcgcccaccaccatgcctggtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaaggccatggattggtgtccctggcagtctggggtccttgccattggaggaggaatgaaggatggacgcttacacatcttggatataaatgctgggaagagcatccagaccccaagcacaaactcacagatttgttccttaatctggctacctaagacaaaggagattgcaactggtcaaggtactcccaagaatgatgtgactgtgtggacctgtcccactgtgtccaggtcaggtgggttttttggccacaggggcagagtgctgcacctgtctttgagtccagaccagacccgggtgttttctgctgcagctgatgggacggcctctgtatggaattgctactagcacccagcccctctaggtttcagtttccttatttctgagtgaagatgatgatgttggctatgtcttctccatggggtttttatgagtatcaaacaagttgaaatactcttcttgatgtgaatgcctgttctcctgttcttcttttgcagattgctttacttgctctgcttcccagagatccgcttcttttcttctctgctttcttctttctgcccctcttcctccccctcctcttcttcctcccattcttacccctttctagagattcattttcactactttattcagaataacatctatagcaaagatttctacttctttcccgtatgacttttctccccagctccaaacctcatatttctgattgcctcaggatagttcccttttgagatactttcctgtctttagctcaatctcaacacattgaaaacacaactcattcacttgaaaaacacttactaaaatctcactatatgctaggcagtatgttaagcatgcatattgctctctctaaaaatcagttctgtaggaatccctttcccctcctgatggtctcatccttatcctggtctcccactcagggaacctcctgattattctgctctgtgcttcctcagttcaccctttgctctcttttcttttgcttcacctagtcacatcctgtgtgcctgacagccagtctgctgtaattgtcttagaactgatcctcttgactccacaccactgctaggttgaacatctaaaagtcctgtgctgatcctctcagtcccctgctcatcaactctcaaggacaacctattaccaaacacctttgacctcaacctctggagtcctcagcccaggacttgaagttaggagatctttttttgccttggctctgccataaatacaccctgtaaccttggatgtgttgcaacatctgcaaggataggaatttgatcactgctaaggttccttcaaacttgatcagttcgctgttctgtcttttgaatgttaattcacattcatctcctatattaagactttggctaagtcttgtgatttcttgccttattggagcttttcttctaatctgaattcttgcttctctctccttttcctttacacacccacacaagtcctaacctctccaggaagtgttttgaaatgatgttacctgggtttgagttcttggcattagcctgtatcatctatttggtattattatactattatagctgtttaaaaaaatcttttattactgtttg

SEQ ID NO: 872 - DNA, 2591 bp, Homo sapiens
agggaggtggtgaaatagaatggtcctgggggacgggactccaggggtttgacgattaggcgtcaagactgacttagacctgggaagaaaaccagaggcagtcgagcagagaggccaaacgccaggcagggcgaagtcagccggagatggagtggaaactggagcgcaccgcgcctcggagggtccgcacggaagaggagatgctgtgggaaagtatcatgcgtgtgctctccaaagacttgaagcagaagagaagtcaagattccgccaacgtactcgattcagttaatgctacgtattctgactttaagagcaactttgcgaagaggctgtccgcagaggttcctgttgcgagtagccccattaccacaaggtggcagcaaagtcaaactagggctctgtcctctgattcctttggggaagagcagtcaaccacctacctcccagaagcttccggatcagtgctgaagacaccgcctgagaaagagaccttgactctaggatcccgcaaagaacaactgaagacccccagcaaaggaatttctgaaacaagtaactctgctctccatttttgcaaggcacctcatgcaatggacagagactggaaagaaagtgttgcctcaaaagggcagaaatgcctaaaacaactctttgtaacccagaacgtggttcagcaggctaatggaaaaatgcagctctgtgagcaatccgaatgtgtttggaaaggctgcaaagatggagtcagagatgaatccttccatcttaaaagttctggtgatataaacgattccatactccaaccagaggtgaagattcatattactggtcttcgaaatgactactatctgaatatcctagattggagttttcagaatcttgttgccatagccctgggctctgctgtatacatctggaatggggagaaccacaatgggattgaaaacatagacttaagtctcacttgtaactatatctcttctgtgtcctggataaaagagggaacttgcctggcagttggcaccagcgagggagaagtgcaattatgggatgtggtaactaaaaagcggctgagaaatatgcttggtcatttgtcagtagttggggctctgagctggaatcactttatcctcagcagtgggtcaagactggggcgtgtttatcatcacgatgttcgggtagcccagcatcatgttggaacacttcgccacaagcaagctgtgtgtgctctgaagtggtcaccggatggcaggctgctttccagcggctgcagtgatggactgctgacaatatggccccacgatccaggtgccagtgcacagggccaaccgctgaaagtcataacccagtctacggcagtcaaggccatggattggtgtccctggcagtctggggtccttgccattggaggaggaatgaaggatggacgcttacacatcttggatataaatgctgggaagagcatccagaccccaagcacaaactcacagatttgttccttaatctggctacctaagacaaaggagattgcaactggtcaaggtactcccaagaatgatgtgactgtgtggacctgtcccactgtgtccaggtcaggtgggttttttggccacaggggcagagtgctgcacctgtctttgagtccagaccagacccgggtgttttctgctgcagctgatgggacggcctctgtatggaattgctactagcacccagcccctctaggtttcagtttccttatttctgagtgaagatgatgatgttggctatgtcttctccatggggtttttatgagtatcaaacaagttgaaatactcttcttgatgtgaatgcctgttctcctgttcttcttttgcagattgctttacttgctctgcttcccagagatccgcttcttttcttctctgctttcttctttctgcccctcttcctccccctcctcttcttcctcccattcttacccctttctagagattcattttcactactttattcagaataacatctatagcaaagatttctacttctttcccgtatgacttttctccccagctccaaacctcatatttctgattgcctcaggatagttcccttttgagatactttcctgtctttagctcaatctcaacacattgaaaacacaactcattcacttgaaaaacacttactaaaatctcactatatgctaggcagtatgttaagcatgcatattgctctctctaaaaatcagttctgtaggaatccctttcccctcctgatggtctcatccttatcctggtctcccactcagggaacctcctgattattctgctctgtgcttcctcagttcaccctttgctctcttttcttttgcttcacctagtcacatcctgtgtgcctgacagccagtctgctgtaattgtcttagaactgatcctcttgactccacaccactgctaggttgaacatctaaaagtcctgtgctgatcctctcagtcccctgctcatcaactctcaaggacaacctattaccaaacacctttgacctcaacctctggagtcctcagcccaggacttgaagttaggagatctttttttgccttggctctgccata

SEQ ID NO: 873 - DNA, 1937 bp, Homo sapiens
gcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttg

SEQ ID NO: 874 - DNA, 1597 bp, Homo sapiens
aagtgcggacctacaaagtttgtccgctccggggcactgtagtggcttttaccctggccgggcgggcggggctcagccgggctgggctgggctccgcggctggagccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacataaaaattcattcaactcttgaaaagaatctaagagtttggccttttattagctagatttcctctcatgttaattagaaaaatcattctgaaaggcaatccattgaaaatttgaggaggttaaattcttaagatcactaaatgttttacctttgatgtaatcggagtgcaattaagaaaaaacttaattctacttaaagtaattgtgtgttccctagtttatacaaaggagttggaatgagcttctttagatcttttcctg

SEQ ID NO: 875 - DNA, 670 bp, Homo sapiens
cggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaac

SEQ ID NO: 876 - DNA, 2092 bp, Homo sapiens
aatcgtccgccgctcccgttaccggggcaaccgcggcgcctcctccgtgtcggccccgatcgtccctccgcgccattttcaaactgctctagcgccggagcccgtgcctggacggaaggagctagtgggggactcgaggcctgagggcaatgcggctggaggcggaggcaacggcggctggagctgccggactttaatttttggaagtgaataaaacttgttttagaagacgagatgactacagctgtagagagaaagtatattaatattaggaaaaggctggatcagctgggataccgccagactctgacagtggagtgtttacctttggtagaaaaacttttcagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtggcaagaaaagaagtattgctttcaggcgccagcgtatgcaaattgatgaaccggttcctccctctgaagtcagttcatatccagttcctcaaccagatgacccttacattgcagacctccttcaagtggctgataacaggattcaagaacttcaacaggaagtccaccagctacaagaaaagttagcaatgatggaaagtggggtgagagactatagcaagcaggtaggatttttatttacttgcatagtagggattgagataggtatgctgtgattgtaaatagaattgggttatatttgaaattgctgatactgagtttttatacagctttcctctttttcatcaggtttgttaatagagttaatagctggaatggcttaggtggctttacttacttagcctgtctcttcaaaaaatttaaaaattagccaagtgtggtggcatgtgcctatggtcccaggtacttgggaggctgaggtgggaggattaatggattgaagagcacttatttactcgattctcttcactattcattgaggtgaatagtagttttttgtttggtttttcttttagctgaatcatctatctccccaaatataattttataaccatattaccgttttcatctcaggagacattttattaagtgtgctatgttttataattgtatttttgtgatttttctactcttattatatattttgtcatattgaacaccagtctcttagaaagttactcttttgtgttgctaatttttttgtttgttttctctataagcacaagtcctcatacaacagttttctgaagaatcaggagaattagtagatgcagagttatattataaccatagcaagctttgtcttttcataatttctattgatgtcttggctaaattttgatttgggtaattataggcttgttttcttaatatgcttcttgaaggttaaattgggtaacatgtttttcattttctgcattgactgcattttttttgagtgatctgcacacacaaatatagatgtaacttaggtgttggtataactaaatctttaaagtgttttgaagattagttggataaaaatggagttaaagaaaattgaccaggcgtggtggctcatgcctgtaatcgcagcactttgggaggccgaggcgggtggatcacttgagatcagaagtttgagaccatcctggccaacatggtgaaacctcatctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctc

SEQ ID NO: 877 - DNA, 3161 bp, Homo sapiens
aggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtgcctgtgtgtatcttaccagctccccagcactgccagactgtgccatgaatggattatgcttctgatgaaatccctggctgcgttttgttcagtcaccaccgcagggttcttgtatattctcaagcaccctctctgggtttctgttttgcagcactgcaggctgattaagggacactttccaaaccacagggctctccctttattagtccccacagtctttcattggctgcattgtcctcccatttctatctatattcaatctaatttccaatttctttagctttctgaaattctgtaggctttctccactcagtcttttctagccttatttttgtctttttaaaaattcaccttccttttattatctctagacaaactattcattccctcttttcttctttaggctttacttttcctgaatatttgctaatagccttgactgtaagcatcaaactcattatagactaggtactcttcatttttatttgttgtttaattctgtttcttccgtcaaaggaagaaatatatgtgaaaggcttttataaaccagaaagcactatacacacatatcacttattgaggttaacaaaggaccactgtgcctcttttcatgctttctgctcttccaagccaagagaacttctccatagaggagggaaatattgaagaaaaataaagccatggagttgtctcttagcaactgagttcgtgccttataaatctcatctactttagattactgctgcacaaaatcacttgcttttcttattggctcagtataaataatgttattaaattataggaaaacaatggaaaaaatctaatgaatgactcattcactgaatcagttgcactctgtgtttgcacagcactgttgctatagtcgggttgtttcttcctcttgattctaattgtaaagttttgttatatatcttttatcacaactttagttgtaagtaaacaaagtagaagctaaatgctaccttatacatttataggttgcttaagtcgtgaagcaatatgagtcatatatgtagcacataacatatactgtatataagtcaagttgtacatagtttaaagaaaatcaggtgtgcagaaactcagaccaaattgggaagtatttgcattataaaataactcattataaggatttttcagttagtagatctccatagtaaatttcattcagcaaatgtgtatttttcctatttatttatttatttatttattgagatgaagtctcgctctgttgcccaagctggagtgcagtggcgtgatcttggctcactgcaacctctgcctcccaggttcaagcgattcttctgcctcagcctcctgagtagctgggactacaggtgcgcaccaccatgcctggctaatttttatatttttagtagagacggggttttactatgttggtcaggctggtctcgaactcctgaccttgtgatcctcccgcctcggcctcccaaagtgctgggattacaggcgtgagccactgtgccaggtctagttatttatttatttattgtagagatgggctctcactgtgttggccagggtggtcttgaactcctggcctcgagcaatccttccacctcagtctcccaaagtgctgggattacaggtgtgagctatcacacctggccatttttttttttttttttttttttgagatagagtctcactctgtcacccgcattgtagtgcagtggcgcattcttgctcactgcaacctccccttcctgggctcaggggatcctcctacctcagcctctcaagtagctgggactacagggatgtgccaccatgcctggctagtttttgtgtatgtgtgtgttttgtagagacgaggtctcactattttgcccaggctggtccggaactcctgggctcaagcaatcctgcctcctcagcctcccaacgtgctgggattgcaggcatgatccagtgcacctgaccatcattcagcaagtatttttgagtgtctcctatgctagacaatggaagggataaagattattcatacgtgtgtgtgtgtgtgtgtgtgtacgtgcccataaatagtccttggctttctgtctagtaaggtaggtaagacaatacagtgataaatgccttgtgagttgtaagccgagtgctatagaggctcagaggagggaaaggtcacttcctgctgagtgagctcttacgagtatgtggcaaggtgatacgttagagaatgcaagactaagagtttgtcaagttaagtaattaaggcaacattaagaggtagtgagttggtgtccagtgctagagcaaggagtttcagctttagttaggaagcaatggggagccactgacttttttttttctttttgatcaaaaagtcttatctgggaaaatgtatctggcagtaatgtgtaatttcaattttttttaaaaaaaattggttcttggatagtcttttaggcttcttttgtatgaaacaaagccatgtttataaataagtgaattatgaaatggattcatttccaatctttttaaaaggtagtcagaaactatcttcagatgcaattagatacagtaagataggctgcatagttaagatgtaagcagtttacacagtgggataaaaatgctacttttcatactttctcaaaccatttttaggggtatttttgtgtcagccatcctgctatctcatttgtccaattaaagcaaggaagaaatcctccattctccttttttccccattcttggatagaatgaatgtctatagtgaaaagaactcatcagtagtcctctcagatttggtctgaatttcaccaaatatttgtataattgcaaaaaacttgtttctcagccttctcctttagggggaaaacaaatagagggcatgatggcctacctccctgcattgtggtgagggtcagctgatacaaaataaagtgttaagtgtaattaccctgaaatgtttgtaattaat

SEQ ID NO: 878 - DNA, 768 bp, Homo sapiens
cccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggcca

SEQ ID NO: 879 - DNA, 3536 bp, Homo sapiens
aagatgcagcggcggctccggttgtcgccgggcgggccaggagcagcgcggacccgagccgggcagggggcgcccgccacggcacccgcgcgctcctagcgccccagacccgcctgcgggcccggatcctccttgccactgtcccacccgccgtccctgccactccaccctttgtgtcgccgcagcccggtgcccccggctctgcgggaccccggccgggccggaccctggcaaagcgccaggccccgcgtgggctcccggcgagcggttgatggcgagggggcgcggcgcgggctctgtagcccgagttcccgacgctggaggcccggcccgcctcagccgcattgtcccgggccgcgcgcaccggccctgagctgcgccgccgcagcacccgcccgccgcccgcggggccatgcggagagccgccgggatggaggacttctccgcggaggaagaggagtcctggtacgaccagcaggacctggagcaggacttgcacctagctgcggagctggggaagactctgctggagaggaacaaggagctggaggggtccctgcagcagatgtactccaccaatgaggaacaggtgcaggagatcgagtacctaaccaagcagctggacacgctgcggcacgtgaacgagcagcacgccaaagtctatgagcagctggacctgacagcccgggacctggagctgaccaaccacaggctggtgctggagagtaaggctgcccagcagaagatccatgggctgacggagaccattgagcgcctccaggctcaggtggaggagctgcaggcccaggtggagcaactgagaggcctggaacagctgcgagtgctccgggagaagcgggaacgcaggcgtaccatccacaccttcccctgcctcaaggagctgtgcaccagcccccggtgcaaggatgctttccgcctacacagttcctccctggagctgggcccgcggcccctggagcaggagaacgagcggctgcagaccctggtgggggcgctgcgctcccaggtgagccaggagcggcagcgcaaggagcgggcggagcgcgagtacaccgcggtgctgcaggagtactcggagctggagcgccagctgtgcgagatggaggcctgtcgcctgcgtgtgcaggagctggaggccgagctgctggagctgcagcagatgaagcaggccaagacctacctactgggtccggacgaccacctggccgaggccctgctcgcacccctcacgcaggcccctgaggccgacgatccccagcccggccgcggggacgacttgggcgcccaggacggggtctcctcaccggcagcctctccaggccacgtggtgcgcaagagctgcagcgacactgcgctcaacgccatcgtggccaaagacccagccagccggcacgcgggcaacctcacactgcacgccaacagcgtgcgcaagcggggcatgtccatcctgcgggaggtggacgagcagtaccacgcgctgctggagaagtacgaggagctgctgagcaagtgccggcagcacggggccggagtgcggcacgccggcgtgcagacctcgcgccccatctcccgggacagctcgtggagggacctgcgcgggggtgaggagggccagggtgaggtcaaggcaggagagaagagcctgagccagcacgtggaggccgtggacaagcggctggaacagagccagcccgagtacaaggcgctcttcaaagagatcttctccaggatccagaagaccaaggctgacatcaacgccaccaaagtcaagacgcacagcagcaagtgacccttctccggcctgcagcctcccccagggtggaagccgtggggtccctcaggcctgggcggtgcagcttccagagagcgagcgccctttagcggcctgccaccacagcacgcggcctcctgatccggaagcacgcagcatgttccctgctgagcggaggcagcccacctgtcctgcctcccaggagcccttggccacctcgcgccagcccaaaggcgcagctctgagttcaaagccaaatgtccccactaccccagggatcccccagctcccccagcccctggcttcctgaccctgcgcctcaccctcagactggtgaccaggcttctgaaagccattctggatcagttggctttttttttttttttggttaagtttgttttttctaagagatttgcaatgcaaggtctccttgaccccttgccacaactggaaacacttgaaaggggaccccagggccagctgtttcaggggtttcctggaccacccactgcttctccccaaccctgatgcgctgacattcccttagcaccagctgtcccacctccagggtcctgaccaggtcagagatgtcccctgccatgcagagcaggaagcctcagctgggcctggagtgtccctgctccagccctgccagggacaggtttctccctggatactcttggcccaccgcagatctgtagccagtcagaggaggaggagaaggagcccctcagcagagtggtgcagtttcgctcagagcttgtctccttggcttccaaccccagaaatgcctgctgggccttaagctttccaggggccggggcagtggggagcccccatcccttcacaccgccaccaactaaccaagcttggcctctgactcccgtctctgtgcttgcccccatctcagggaccatgatgtctcagtcactccacgctccccacaggccaaccctggcacaggtcatgtctgcagcccccagaatgttctggacatgcaccaccagccggtggtcccaatgtccacccctgcctccccttcactggggactggggttttcgccccatgctgcatcgtgttgtattgggatggggctgaggaacatgctccctccctccctcccataaaatgcctgctcttcacctcccacctttgtggggggcttttgaggacccagctgcgtcaggagttttgcttcaagatgtcagaaagtcaagttcagctaagagacacccaggtccccagcttgccctgagcagcccttcagggcttctggttccttctgccgcccttcctgagaccttagaaaccagaagagccatacagtcagtggaaggcgggggggccctggcctctgcaccgggatcccagtgggaaccttcatgccttatttatttctaatgggtaaaggggttttcttaccaagcatccctgacctcctggagacaccacctgctttccgggcggcactgtgatgggagctggtggcgactgagtccttctgtacgtgcaactgggaaacttttgtcctttgaggctaggcagctccctgccctccgtgtgtgtctgttatctgggggagaggagtgtggaagggttgggggaagagctccagcctgtctgctccccagctctgtagtggcagaccagcgtcacctttgaagtatacgtgagagaaatatatttacaaatgctttattctcttctttaataaaaaatgcaccagtattctaaaagcaaaaa

SEQ ID NO: 880 - DNA, 1321 bp, Homo sapiens
gcgcggccggttactcgcttaccggaggcttcagtccccggcggcgcggcgacagctagggttcacggccactggggcagaggagccgcgagaagatgtgggtttttggttacgggtccctgatctggaaggtggatttcccctatcaggacaagctggtcggatacatcaccaactacagcaggcgcttctggcagggcagcacggaccaccgcggggtccccggcaagcctggaagagttgtgactcttgttgaagatcctgcgggatgtgtatggggtgttgcttacagattgccagtaggaaaggaagaagaagtaaaagcataccttgacttcagagaaaaaggaggctacagaaccacaacagtcattttttatccaaaagatcccacaacaaaaccattcagtgtattgctatatattggaacatgtgataatcctgattatcttggtcctgcacctctggaagacattgctgaacaaatttttaatgcagctggtccaagtggaagaaatacagaatatctttttgaacttgcaaattctattaggaaccttgtgccagaagaagcagatgagcatcttttcgctttggaaaaattagtaaaggaacgtttagaagggaaacagaacctcaattgcatataatttagtcttcagagaattaacttcagtgcacaatgacaatatgatttggaaatacgtttacttaaagatcttatttttaatgtagtgaggatattatttaaacttttattttaactggaaatgtcctgaaacacatatttaaaatattgggatacagtgaaagaaaaattcaaattttaataacataaagatttcctaactttatgttattgaacacttactcactagaagtgagttctttagaaaaatacagtgaaggactcagttcagtcttgtttttatcagagtgataatcatcctgtttcacatcccaatactattttgaaattctaaacaattaaaccaaaattccaataaatataaggttatgccttcaatatattcctatacaattctgtaaccatggtttaaaatacacaagcttaaaataacatgcttagaaatacacaataatatgaacagtatttcagccttaattgtgaatttccttgttattcaagtattaaatgaaatcttttgagtttttagccaaaaattggcatttttaaaatacgaaaatttccttggaattataatgtactgtacctcttcttttttaaataaaggcattttactatatggaaaataactcactaaagcataaattacattatacaaatcatgatcactaa

SEQ ID NO: 881 - DNA, 703 bp, Homo sapiens
agaacctcagaaatgtgagttatttgggaatggctgtttgtaaatgtccttacgtaagccaagaggaggtcttgacttggggtcccaggggtaccgcagatcccagggactggagcagcactagcaagctctggaggatgagccaggagtctggaattgaggctgagccaaagaccccagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaactgccacacgtgggagtgacatatccaagacctgctgcttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttga

SEQ ID NO: 882 - DNA, 785 bp, Homo sapiens
tgaggactaacggggaaacatcctccgagaagatacaatctcaagggtgggcctggatgtgggcttccagagaccatctccctgaaccagatcttggggatgcagcgccccctggctcgccttcatcattctggacatccgggctcccgagacaagagcgcagcacgagtcgccagcgctcccgaggctccccttcgagcacctgcgtgccctacaaggtccacgccctggcaaccttcgagtgctcggctacgagccatgccagccgcctgtggcagacgctgcagcagttttgggccgatcacatctcgcggcccttctcgccacggcggccgccactgcgccgcatgccctccctgtccaccttctacctgctggaccacaacacgcgccaggccgagctgggcctcgcctacggcgcgccgtgcatgcgcctcagcaaccaggccttcgtgttccgcggcgggcggtggaccactgagagccagctggcgaggacgcggtcgccgctgctctcgcggaccgcctggggctggaaggcgcaggtgcagcggtccaaaagccaagtgttgctggaggagaacaactacctgaagctgcagcaggaactgctcatagacatgctgactgagaccatggcgcgcatgcacttgctggagaagcagcgcaaccccgaggtgatcccgacggctgcggcgcgcgccgggcagaggaagatgcgcaagcgcgcaggcgccagcgcgggcgtgctcatgatccagccgtgcgctctggactcgcagtga

SEQ ID NO: 883 - DNA, 875 bp, Homo sapiens
acttccctgggttcacagcaggggtggaactggattcttcctggatggggatccagatggaggtggagctgcaccccttgtagagaatggctgcgggtcccaggccaggagctccctgcagggcgggagctcccacgatcgtattgacctctggaagaagacagacactttcccacgggagctcctctccagccagagctacacttggcaaacctttggtcctaaatgatttattcactgaattgaagaaatacggtttacatatcttccaagtatatatgtagggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggttcccaagacaacccaaaagggaaaagggacccgtcaaggaagttccaggaacaaaaggctctccctaaaagaccaccgcttcaaaaaaacctgaggaatggagtgggccaacactatccagccactctgaccagccgaaccaggaactcaatcaaaatgcgccacagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatagaaataaaatgaacatgttgtaaaatga

SEQ ID NO: 884 - DNA, 1037 bp, Homo sapiens
atggggatccagatggaggtggagctgcaccccttgtagagaatggctgcgggtcccaggccaggagctccctgcagggcgggagctcccacgatcgtattgacctctggaagaagacagacactttcccacgggagctcctctccagccagagctacacttggcaaacctttggtcctaaatgatttattcactgaattgaagaaatacggtttacatatcttccaagtatatatggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggcgaggaaggggaaagcatcctctcatccctggcccagaagccctatcaaagtgaatggcccacccaagctctgactcctaccctgtcctcccctggcacaacccccaccccagcctgtaccatttctctatgaaacccctgttctcacccctcctccatcctcttccccaaaccagtgccctcctgtgatctccctgttggctttccaggttcccaagacaacccaaaagggaaaagggacccgtcaaggaagttccaggaacaaaaggctctccctaaaagaccaccgcttcaaaaaaacctgaggaatggagtgggccaacactatccagccactctgaccagccgaaccaggaactcaatcaaaatgcgccacagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatagaaataaaatgaacatgttgtaaaatga

SEQ ID NO: 885 - DNA, 627 bp, Homo sapiens
ctggattcttcctggatggggatccagatggaggtggagggttgatttgggaagcagagcacagcagcccaaatttgcttgtaatgtcggcgactacagcctgctggcctgccttcactgtcctgggggaagctcggggagaccaggtggactggagtagactgtacagagacactggtctggtgaagatgtccaggaaaccacgagcctccagcccattttccaacaaccacccatcaacaccaaagaggttcccaagacaacccaaaagggaaaagggacccgtcaaggaagttccaggaacaaaaggctctccctaaaagaccaccgcttcaaaaaaacctgaggaatggagtgggccaacactatccagccactctgaccagccgaaccaggaactcaatcaaaatgcgccacagcaggaccacaagggcaaggagaccaccgccttctccagtgcttccttgggcagccagtaattcccaggcaaggccagagacttcaagtctatctgaaaagtctccagaagtctaaccccagataaatagccaacagggtgtagagtacgttttacaccccaaagggtatgccccatggtgatagaaataaaatgaacatgttgtaaaa

SEQ ID NO: 886 - DNA, 796 bp, Homo sapiens
gtgcaatggctagtactatgtgtcaacttgtctaggctatactgctcagctgtgtggtcaaacagtagtctagatgttgctgtgaaggtattttgtagatgtgatcaacatttacaatcagttgattttaagtaaagcagtttaacttccataatgtggatgggcctcatccaattagttgaaggtgttaagagaaaagaccaaggtttcctggaaaaggaattctaccacaagactaacataaaaatgcgctgtgagtttctagcctgctggcctgccttcactgtcctgggggaggcttggagagaccaggtggactggagtagactgttgagagacgctggtctggtgaagatgtccaggaaaccacgagcctccagcccattgtccaacaaccacccaccaacaccaaagaggttcccaagacaacccggaagggaaaagggacccatcaaggaagttccaggaacaaaaggctctccctaaaagaccgccgcttcaaaaaaacctgaggaatggagtgggccaacactatccagccactctgaccagccgaacgaggaactcaatcaaaatgagccatagcgggaccacaagggcaaggagaccaccaccttctccagtctctcttcggacagccagtaattcccgggcaaggccagagacttcaagtctatctgaaaagtctccagaggtctaaccccagataaatagccaacagggtgtagagtacattttacaccccaaagagtgtgccccatggtgatgaaaataaagtgaacatgttgcaaaatga

SEQ ID NO: 887 - DNA, 627 bp, Homo sapiens
gttcccgtgccgcgtccaacacccctcactccctgtctcactcccccacggagactcaatttactttccatgtccacatccccagtgcttgcggaagatatcccgctaagagagagacatgtcaaaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagcccatcccgactcccggggccctcagacaccccgatcctcccacaataaaggcttctcaatccgca

SEQ ID NO: 888 - DNA, 730 bp, Homo sapiens
ccccagggccagtgagggccctgcgttccgtggcgccccctggagggaggaaggggaactgtatctgagagagagcagccaattgggtccgctgactccggccgggttcccgtgccgcgtccaacacccctcactccctgtctcactcccccacggagactcaatttactttccatgtccacatccccagtgcttgcggaagatatcccgctaagagagagacatgtcaaaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatcccccgcttccaggcctcctcttcctcaaaggcccctccccccagccttccaagcccatcccgactcccggggccctcagacaccccgatcctcccacaataaaggcttctcaatccgca

SEQ ID NO: 889 - DNA, 3386 bp, Homo sapiens
ctttcattggctggattggggtgggcgggttctgtcacctggggcaacagcaacaaaccagctcctgcttggctacagggagggggtggaaccatggccagtggcaccctggctgtgcgctgtggccccccgtggtctttcatctctgcaaccgagatgcctgaatcctggcccaactggcatctcaccagcagctacgttacccatggcattatcccacccgtacccttccccccgcccacggtgcaggtgggcagaccctaggctgaagccctgcggggcctggggacccagaaagatgggggctgagaaaaggggattgggagcttggactcctctctgaaggaggagggtcctggagtcctgggtctgagagaggaggcgccagggaatttggatgccagggactgcagaggaaagggctgggggccgactggaagaggtcagagtttggggtggggggtgatagggactcctgagtctttctagctgatgtgcggcgccttctctccagtccacggtcgcggaccctctacctccgactgcaaagcaggattctcgcatctgggctttcgacgaggtcctcagcagatgggagacaacctctggctcggcctacgtgcccaagacccatggcgggccctgcgcccagcccagagccccagagcctgcagaccccacgcggactgtggggatcaaggattcaggagaaaagctcagacaccgcagctgaaccctcctactgaccacaaagtaccagagcagcgagacgagggcgcagtacacttgctctcccggcccggacgcgcgcgcccccaaatacgtcgggccccagcccctcacaactctcggaccaccaccgcggggggccttcccaggtgtctgggtggaagccggcgctggcgagaccagcggagctccgggagcctggggcggggccagaaggaaatcacagctttggggcgtggctaaaggatctggggcgggatcgggaggttagaggagcgggaggaagggctgggcatccacgccaggccagaaggaccaggggctggaaactcgccttcagggctcctaagctgctgcggagctagacggcgggctgtgggtggggaggagactagaatattctgagacgtggtagggtgggagttaggagaggtaacctggagttgttgcccaagatgcagctcagctccagtggccacaccaagaaggcttgagaccgggggcagaaccagggggattttgtggtggctgggggcctgcatttgagttccttgaccagcaggagggcttggatttagggaggtgaggctgggaagggttcgggtatgagaaaggaagctgaagttccctggcgtgggtggcaggaagggctctgaccctggggcggggtgtgagggccgtggccgtcatggctgtcgaggccgaaggagagggattctgaactcgggacccaggacttgggatggggtatgaaatctatgtcttgggtatgcctcctcccccaatcttgctcaggctctaatcgcctgcacgaagaaccccgcgctgtctggcccacccttcacagtatccgaccggggcgtcctgaaccgccgccagctctatctgaccacctcggcgcgggactttcggttctatcccaagacggagccgtccggatacccccgcaaggactacctgacctactggagcttagaagagacgccccaactctggagtcacgacccgcagcggcagccctgtctctgctcttccaggccgcctcgagcgccgcacggcgggccatgtctccggctcaggaaacctacagctcctcgccgcacccgctccgccggctcgaccgcttccgcccgctggaggcgacttggggtggcccccactggaagcccctgccgggcatacacagcgtcccgaaagcctacagcaccgagaactcccgctcaggccgctgtaagccggggctagtgggagcctgccgggccagccccaccccagacacgccccctggcgtgggggcggagcagagctctgggcagccgctcactacgcggtgtcggacctaggtgggctcgcactcattaagtctatccgcagtgtggggacaggactagcccagacacgcccactcagctgcggctggatcgcggggaagggactaagtccagacaatgtcctccgaggctgcggccccgcgggcaggacacacctcctgcgggcctattcaataatcagttaaatcacctgaagcacacgcatttccggggaccgctccgggcatcctggcttgagggtagggtgggcggaggttcctaagggagaggtggggctcgggctgaatccctcgttggggggcatctgggtcaagtggcttccctggcagcacagtcacggggagaccctctctcactgggcagaagctaagtccgaagccgcgcccctcctgttaggttggactgtggtgcaggaatggctcaagtagaggagggttgaggcttcagtccagcacctttctcgggtcacggcctcctcctggttcccaagaccccaccataggcagaggcaggccttcctacaccctactctctgtgcctccagcctcgactagtccctagcactcgacgactgagtctcagaggtcacttcaccgtggtctccgcctcatccttggcgctagaccactgaggggagaggactggggtgctccgctgagccactcctgtgcctccctggccttgtctacttctcgccccccgaagggttagtgtccagctcactccagcatcctacaacctcctggtggccttgacgcccccacaaacccgaggtataaagccaggtacaccaggcaggggacgcaccaaggatggagatgttccaggggctgctgctgttgctgctgctgagcatgggcgggacatgggcatccagggagatgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagtccatcccgactcccggggccctcagacaccccgatcctcccacaataaaggcttctcaatccgc

SEQ ID NO: 890 - DNA, 880 bp, Homo sapiens
tccagcacctttctcgggtcacggcctcctcctggttcccaagaccccaccataggcagaggcaggccttcctacaccctactctctgtgcctccagcctcgactagtccctagcactcgacgactgagtctcagaggtcacttcaccgtggtctccgcctcatccttggcgctagaccactgaggggagaggactggggtgctccgctgagccactcctgtgcctccctggccttgtctacttctcgccccccgaagggttagtgtccagctcactccagcatcctacaacctcctggtggccttgacgcccccacaaacccgaggtataaagccaggtacaccaggcaggggacgcaccaaggatggagatgttccaggggctgctgctgttgctgctgctgagcatgggcgggacatgggcatccagggagatgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggcctcctcttcctcaaaggcccctccccccagccttccaagtccatcccgactcccggggccctcagacaccccgatcctcccacaataaaggcttctcaatccgca

SEQ ID NO: 891 - DNA, 1068 bp, Homo sapiens
cttgagctgtaggcgcggagggccggagacgctgcagacccgcgacccggagcagctcggaggcggtgaagtcggtggctttccttctctctagctctcgctcgctggtggtgcttcagatgccacacgcgtcccgggggcccggttctccgctcccctcccctccccttctcgccggaccccgcgccgggagctgcgggaaggagtggagggtcgggcggtggcctcgcggctggcctggcgcgcggccagcgccggtagttagtggggggactgctctgccctcgagggggtagggagctgtggcgacggttgccccatttcgagacaaagcgcatttccccctcccctcccccacccgcgttccggcggaggcgccccctcccccagccgccacgcggggctgggtcgagacttgggcctcccggagggcggcgcgtggtcccgcgtccgcgaggcctggcggcgcgcggccggctgtcccgaggctgcggcgaccgcccagttaacgtggccgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcctctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgtttaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaac

SEQ ID NO: 892 - DNA, 2396 bp, Homo sapiens
gcgttgggaagttgggagggaggtgcgcgcttggccgcgcggggcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcct

SEQ ID NO: 893 - DNA, 2413 bp, Homo sapiens
ggagcgcgcgggcgctactagccgcgggggccaagcccctggcttcttactgcggcttcatactgagggccgagccgaggcggcgcgggtgcaggagcaggacttacggcagtgggggctgacagattcccttggagtgttcttgttgtggatgaagctcacaggttgaaaaaccaaagctccctgctgcataagaccttgtcagagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcct

SEQ ID NO: 894 - DNA, 2967 bp, Homo sapiens
gcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcattcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcagtttggttctcctggatgttttgctctgttttggtacctgtaatatagggaaacacaactttttttgggaaagccctttgaccccagcttgctagttgcataataataaattttctgttcctaa

SEQ ID NO: 895 - DNA, 9830 bp, Homo sapiens
atgtcttcagtgaagaggccaagaggaaggcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactacccatg

SEQ ID NO: 896 - DNA, 11461 bp, Homo sapiens
gagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactacccatg

SEQ ID NO: 897 - DNA, 11464 bp, Homo sapiens
gagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagcagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactacccatg

SEQ ID NO: 898 - DNA, 3557 bp, Homo sapiens
caaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggtgaagaagcatgtacgagaaaaggagtttacagtgaaaatcaaagacgaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactga

SEQ ID NO: 899 - DNA, 13110 bp, Homo sapiens
gagtcccaggattccggggactggagggcagcgccggcagccaaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtggggaacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgacaaattaaaagaaaaaaatacgcagaagatatagaagggaagcaatctgaagaagaggttaaaggttctatgaaaataaaaaagaattcagctcctttacctggtgaacagcctttacaattgtttgtggagaatccgagtgaagaagatgctgcaattgtagacaaaattctatcttctagaaccgtaaaaaaggaaatatcacctggagtgatgattgatacagaagaattttttgtaaaatacaagaattactcctatcttcactgtgagtgggccacagaagagcagcttttgaaagataaaaggatccagcagaaaatcaaacgattcaaattgagacaagcacaaagagcacatttttttgcagacatggaagaagaaccatttaacccagactacgttgaagtagacagagtattagaagtctctttttgtgaagataaggatactggtgagcctgttatttactacttagtaaaatggtgctcattgccatatgaagatagtacttgggaactaaaagaagatgtagatcttgcaaaaatagaagagtttgaacaactgcaagcttcaaggcctgacacaagacgtttggaccgtcctccttctaatatttggaagaaaatagatcaatccagggactataaaaatggcaatcaactcagggaatatcaactggaaggactcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgatcccagtgtacccactcccccaggtgccggtgttaaagaagaacatgatcagtcaacacagatgtcaaaggaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactacccatgatgtcagcctctgtacatgagaatactttttaaaattgaattttatatagaatttatcttattccagttatgagagacaccatagttgtaaatctttaaaaggaaaatataccgtggaagaatttttaaaacaaaaattggctataattttatccacagtatcttaaatgctgtcaatttttcattttgatttaattttattaatattgttcattgtggatattggtgactgcaaaaaaagcaaaagctgcttcttgggcattcaaattgttaaaccccaattttgcagcccaatctcaacttcatgctgaacattaagtattattttcttaagtttttggacttttaaaaaactcagaaatactcagagatattcctcacctctttaagaagtccattttggaaatcaataattatttttttcccttagtcttaagagtgtttcctaactcattgccatgggtagtgttcttcgtaaacattgaagaaaatagtttttcctctaattacacaactaaaacagtggagtctcatactcatttaacttgaacacattcaactacactttcatgtttagaaaacctttttttcatttttgtacaacataacatataaacacaaaccaactgcttcatctagtactcacccagaggaacagtagtctgttccagtgttggaggaagaattgcctatgttggacatttttgagaagagatatgaggtataaaatgatgtattctgtaatttgtgagctctgtgagagaaaagagtgattttttttttttttataaagacaaggtcttgctctgcctcccctagggtggagtgcagtggtgcgatcacagcccactgcatccttgacctgttgggctcaagcaatcctccctcctcagcctcctgagtagctgagactacagcatgcatcaccacaacgagctaatttttgtattttttgtagagatggggttttgccgtgttgcccaggctgatctcaaactcctgggctcaagcagtctacccatctcggcctcccaaagtgctgggattacaggtgtgagccaccacacccagccagaaatgatttttgactacacctaatattcactttatacaataaacttagaacttaatctctatataagctatttattttaaaattcagaaaagcaaaaaaatatttaaatcattcataaactaaaactacccagagataaacactgtcagtaatatattcaatcttttgtatatctatgttatttacatgtagtgggttgagtagtgtcattcagaaactgatgtcaacctaaaacctcagaatgtggccttattttggaaatcgggtcttggcaaatgtaattagttgtagtcatgccggattagggtgggccctaaatccaatgactagtgtccttagaagaagagcagaagatactcagaaacactgggaaggctgttttgtgataaaggagaccggagggatgttcctacaactagggaacaccaaggattgccagcaaccaccagaagctaggagagaagtaacaagcattctccttcatagcttccggaaagaaccaaccttgccaacaccttgatttggggtttctaacctgaactgtaagagaataaatttccattgttttaagtca

SEQ ID NO: 900 - DNA, 579 bp, Homo sapiens
actctgcagttgatccagcagcaggaggcagctgtacccatcactgtcctcagagtacttttaagaacaaggaggtctctgcccacggcagcccaagcagattcccatccatcatgactgccatccgactacgagaatttattgagcgtcgcccagtgatcccgccaagtatattcatcgctcaccaaggaagagacgttcaaggctattaccctgggcagctggcaagactccattttgatcatagtgcaaagagagctcccagaccgctcatagacttgacaattccacccaagacaaaatatcactatcagcctcaattagaccaacaaacactcattcgatatatttgtcttcgaagacattcaaagcctgccgagccatggtataaagaaaccacttaccgacgagactattctctgccattttatgagattgattggaaccagaaattagccacagtttcgctgaatcctcgaccgcttaattcactgccagagctctactgttgtgaagagagaagcagctttgaaagaaatgcttttaaactaaaataaccacggcattcgaacaaaataa

SEQ ID NO: 901 - DNA, 483 bp, Homo sapiens
actctgcagttgatccagcagcaggaggcagctgtacccatcactgtcctcagagtacttttaagaacaaggaggtctctgcccacggcagcccaagcagattcccatccatcatgactgccatccgactacgagaatttattgagcgtcgcccagtgatcccgccaagtatattcatcgctcaccaaggaagagacgttcaaggctattaccctgggcagctggcaagactccattttgatcatagtgcaaagagagctcccagacattcaaagcctgccgagccatggtataaagaaaccacttaccgacgagactattctctgccattttatgagattgattggaaccagaaattagccacagtttcgctgaatcctcgaccgcttaattcactgccagagctctactgttgtgaagagagaagcagctttgaaagaaatgcttttaaactaaaataaccacggcattcgaacaaaataa

SEQ ID NO: 902 - DNA, 985 bp, Homo sapiens
atgtaaatcacacagatgttggtagagaaaaaggcatactggtattgaaactgtaaactggcctgtttacttcgtctcctaacaaaaaacactttggattcaggttctccacagcagtcttccactggccacagtgaggggagctaggtttccccagtctccagctagaaaaactcagaacatctaaagatctgaaagatggaaaaaagagaactaaaggcttctgttccaaaatttgacaagattccttggcttagtgaggccagccttgtaaacaagccattagtgctcagccttcccagaagatatcctcatacctctgcgacttttctgacttcatccaagaagaatatgaatttgccaattttgtttcaagttccagatgttttatctaaggccaggaggaaccagtgtgactccatgctgctcagaaaccaacagctgtgctccacatgtcaagaaatgaaaatggtacaaccaagaacaatgaaaatcccagatgatccaaaagcatcctttgagaattgtatgagttatagaatgagtcttcatcaacccaaattccagactacacctgagcctttccatgatgacatcccaacagaaagcattcactacagactgcccattctgggccccaggacagctgtcttccacggattactgacagaggcctacaaaactctaaaagagagacaacgttcttccttgcccagaaaggaaccaataggcaagacaacgaggcagtgagcggtaggagctcatcacctcccagactcccagagagaaaataacctcgccaagccaatctttgacactggcaccttctcctcacaattttctctcttctcccaaaagatgatttaattttgccttcctaagattgctggtattctagctcttacctctatgttctttctcacgtctcctaaagacaaaattgtttaatttacatgattataaagatctgtttatgaaaatggaa

SEQ ID NO: 903 - DNA, 4298 bp, Homo sapiens
ggggcaaaggggacagcctcgcccctcgagcggctgctcccgcagctcgctcacccctgcgggtacgtcgtcactcccgcgtgcggccccgtcccgactcttggatcggactcttcagtcccttcttgcgtcttcccctctttcctctgggccttggtatgccccaggggacagatgtcttgggatctttaacatttgggatgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctg

SEQ ID NO: 904 - DNA, 2197 bp, Homo sapiens
attagttcagggaaggacttgctcacctgctcctcccctctgactcaagtcataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcag

SEQ ID NO: 905 - DNA, 708 bp, Homo sapiens
ccggggagaggggccatccccgcgcgacccgcagcgccgcacagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcggaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcc

SEQ ID NO: 906 - DNA, 570 bp, Homo sapiens
ggagtgggagtgggccggggccagggccggggagaggggccatccccgcgcgacccgcagcgccgcacagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcggctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccc

SEQ ID NO: 907 - DNA, 2355 bp, Homo sapiens
gagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggtaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgacaggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagca

SEQ ID NO: 908 - DNA, 1498 bp, Homo sapiens
gtgccaggcaggaatggcctgctaggagatgcagtgagcccccaggacctctccactgcctcctccacccctgtatttcacttggctctccaaattgactcaactccagaccataaagaagatggagaggcacatggtcaggggacaattgtataagcattttgatttggagaggaagaatgccaagcaggctgaagccagactggaccaaagactgcagagactaaaggttatttgcctctaccatgtgaaattgctgacctgggagcagaggcagctccaaaaagaactgcagaggttgcagcaagcagaaaccatgaagaaaaagttctcctcttatttggggaatggatttcagaagagaccagaagatgttctcgtgttctcaccacagggaaggcagaagcacagagccccacaggctaagaaaatgagagcattggcaacccgtatggcccaagacacatgcaaaagcaagtcccaggtgcctccttcacatgatgctggcctcaaagaccccatgaagagcaaaaagcagccactctctcaaaataacagaactgcctgcttcataaaagagcaaccacaagcccaagagaaagattctgtgaatccatctaaggacgtagaccccagcaagggcatctctgttccatgccaaaatcaagaggtttccaccaacaccatagaacaaggtcctagttccagcccagctagtgatagtggaatggcatgtgctgatgagaccagatcaaaagatgttgctctaaagccagatgggaacactggaaaacaaattcccccaaaacacatggaatgtgcaggaagcttcgaaggcgagttcacaaagccaaccttcttagagttgctttcaaaggccagaaatgcccattatctccggcacagggtcccccctgagtctgagaggttgcttagcattggagagatatttgggcatggggaatcctcatcatccagggcaggaaaggagtgtgaaaacagggtgccttctaagtttcttcctctctaaccgtttaacatagcctgacaataacatatgccattattgctaaggaaatgtgttcctcaaatgactatattaagcaatacagagaaaaacaaacaaacataattgaattacaattttattttaaactccctattattttccgggaatataatatttcttgaatgaacaatgctaatatatgaaaaaggagaggaagaatgaatcttctgaaaatattttaagtgatatgtttatgatgtcatcaaaaatatgaatatatattgatgactggacttgggaaaacagtaacagtcttgctttcagggacttcctgtttcctctaggagattctcatggtgccacctgctggcaaaacggcatagctattctctctgttttagtttgatatatagtagtggtaggaataggaatgtgattgtaaataggtactgtaacatggtctataaagaaaatctgctctttaaccac

SEQ ID NO: 909 - DNA, 895 bp, Homo sapiens
ccccatggagttctacccctgctcctctggtcaccctcctgatggatccccatggtgccaggcaggaatggcctgctaggagatgcagtgagcccccaggacctctccactgcctcctccacccctgtatttcacttggctctccaaattgactcaactccagaccataaagaagatggagaggcacatggtcaggggacaattgtataagcattttgatttggagaggaagaatgccaagcaggctgaagccagactggaccaaagactgcagagactaaaggttatttgcctctaccatgtgaaattgctgacctgggagcagaggcagctccaaaaagaactgcagaggttgcagcaagaaaccatgaagaaaaagttctcctcttatttggggaatggatttcagaagagaccagaagatgttctcgtgttctcaccacagggaaggcagaagcacagagccccacaggctaagaaaatgagagcattggcaacccgtatggcccaagacacatgcaaaagcaagtcccaggtgcctccttcacatgatgctggcctcaaagaccccatgaagagcaaaaagcagccactctctcaaaataacagaactgcctgcttcataaaagagcaaccacaagcccaagagaaagattctgtgaatccatctaaggacgtagaccccagcaagggcatctctgttccatgccaaaatcaagaggtttccaccaacaccatagaacaaggtcctatttcatcagcccagcctctggccttcaatggggagacaatactttatagtgaaaggaacacaagaaatctgcttcctccaacactttcttccatgaagcaaagcaacagaggaaggcaggccataagtgacagaactgattga

SEQ ID NO: 910 - DNA, 1189 bp, Homo sapiens
agaatgtttatcctctggacaaaccagccagcctctccagagcaggcgtgtgatctctgtacccccgcagtggtcagaatatggagaacttctcactcctcagcatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagcgctctcaccagactgcagcttgggggatacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccaggtggcacccagcacagcagaatggctacaagtgcgtggcctgctgccgcatgtaccccaccctggacttcctcaagagccacatcaagaggggcttcagggagggcttcagctgcaaggtgtactaccgcaagctcaaagccctctggagcaaggagcagaaggcccggctgggagacaggctctcctccggcagctgccaggccttcaatagtcctgctgaacaccttaggcaaattggcggtgaagcctacttatgtctctagagagatgccaataaagttagtcacagccttctgtccagtctgaggtcaccccgcacagcctgctgtccttcccagaacccggctctcatcacctttggctaatggttgcctagcaacaccaggcacacaccctcccctttctctcttttaaaaataaagacaatacttgaagtttgggaaaatcatctaagatagaggttctcaaaggtgcccagctggcagtaccagcaacccctgggaactctcaggccctcctcagacctactgaatcagaaactatgggtctggggctggcggtctatgtcctaaccagccctccaggt

SEQ ID NO: 911 - DNA, 1914 bp, Homo sapiens
gctctcgtagttagagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtgttgtaa

SEQ ID NO: 912 - DNA, 1860 bp, Homo sapiens
agtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagacaggaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtgttgtaa

SEQ ID NO: 913 - DNA, 1246 bp, Homo sapiens
agagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagag

SEQ ID NO: 914 - DNA, 2035 bp, Homo sapiens
ggggtccaatttgtgcgcgtggagtgagacagaaaacctggagcccgatctcccggccagcgactccctccttctgggtgtgcggctgaagactggaagcaggttgccttgcctgctgcaagcccgccgtacctaccccttctccgcgtgcgcccctccctgtgcctgcgcattaccggctagccggcggcgggcgctgcagcccctacgtgattctgcggctcactcccctcggatggtctttccacccgagtttttcccgggaagaggctctcaagactagccagtgcaggaggaggagtcgaactctggatagcctgtttataaagccctaactgtgccgatgttgaccgttttctgaaactcctcctccaaaacccacgccaaaccacaagatgaaggaaattcacacatcaggatgccaaaaaccatggaagacttctgatgttctgggagggttgacaaagatggaccttaaattctagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactga

SEQ ID NO: 915 - DNA, 3413 bp, Homo sapiens
actttttcactgagtcagaccgttgaacaccgtggacacactgtcttgcgtttccgaatatttcctagaatacggacgtttcctaagactcacgataaagattttctgatcgtctctccaaaaccttgccaccaatttgcactcccacgaatcctgttaccgtgactatctcgccatgccctccctagcactgagcgtgatctctagtatcattttccatcgttgctaatttgaacatgagcagatggagtcctattatttggggtcattaatttcgtagcaagtgcagttgaaggtgttttgcatgttcattgtgcagtgcgcgccgtagtctgcacagtttggccggcaggtgggatgaagggcggggctggcggagcgcgcccgccgcctggtaggccagttcggagcggagccaacgctatcccgggccccacggccagggggcgctgcggcccccccaatcccccgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaatgtt

SEQ ID NO: 916 - DNA, 973 bp, Homo sapiens
gccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacggggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctc

SEQ ID NO: 917 - DNA, 2229 bp, Homo sapiens
gtaaggcaaggggaaagggatcatgagaaaggttggaagggataagagggtaagtcttatctggatcctagtgaaagccaagtggcctggagtctggggacacaagagaaaacttgactcacaggcgtaaaagggtttaggtccttgttgagctcctccgagcgttccatcaccagggtcactggtcctggcagtaggtctttcaggagcccctcaggtactctcacacggcagtatctgggaaacacagaagaataaatccattcaaaattgaagggccactggtggtcctttcctagactctaggcagacgtagaaaaggaatccttcgagtttacaatgggagccgcctgtctccctgcttcacctccctaagagcttgagcagaaagcagggctccagaggcgcacccctggcttgacgcccatgtgcctctggtctcagggactacaacagctgcaccgctgtgatatcatgatagtgggatcaagctccacgttttattttcttcaaggcattcgctattaaattaagctactgtgtttgtttgcttttttcccgggggcctccccaattagcacaaatacgccaagggaacagggtccctgcctttctcgtgtgttgctgcttcccagcagcatgtagttcagggcccggggcacgttaagtcctcggtacatatttccagttccggattccttggtgagcctggacaagcccctcccgctctctgcgcctcagtctcccaagcctgtcaccggaaacccctcccgcggtgccgcccctagcggggccgggtcggggcggccttacctgtagacgtcggccacgcggccgaggcatacggccagaggcttggcctcgctgcgacccttgaggcggtacacagcgcgcagagccgccgagcagctcgccgcgcaggccaggccgtacagcgtatcggtggggacggccaccacggcgccggcgcgcagctcggccacggcggcccgcagcgcctcggtccagccggcgcgctccgggctcgcggcctgcacggccccgctccccgggagccgcaacagccgggcgccgggggccgccggagcgggactcggcgggcggaagaggcgaccgctccgggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccggtggggacggggcggggcgcagccttgcgaagccctaacgcagcgctggggaggggggcggccgaaaggggggcggtggtcgggccgcgcaagcggagatggaatggggcccgggctcagactggtcacgggggtgagagggggcccgtcggggcgggaggaaggggcttggccccgcgcaagcgccggccctgaccgtctgtctctcgctctctcccgggcagggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactc

SEQ ID NO: 918 - DNA, 800 bp, Homo sapiens
atggggcccgggctcagactggtcacgggggtgagagggggcccgtcggggcgggaggaaggggcttggccccgcgcaagcgccggccctgaccgtctgtctctcgctctctcccgggcagggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcagactctc

SEQ ID NO: 919 - DNA, 1234 bp, Homo sapiens
tcccgcggtgccgcccctagcggggccgggtcggggcggccttacctgtagacgtcggccacgcggccgaggcatacggccagaggcttggcctcgctgcgacccttgaggcggtacacagcgcgcagagccgccgagcagctcgccgcgcaggccaggccgtacagcgtatcggtggggacggccaccacggcgccggcgcgcagctcggccacggcggcccgcagcgcctcggtccagccggcgcgctccgggctcgcggcctgcacggccccgctccccgggagccgcaacagccgggcgccgggggccgccggagcgggactcggcgggcggaagaggcgaccgctccgggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccgggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacggcagctgggccgccggcgcccggagccggctggtggcgggaacgtctcagccaaacctggagcgcccccccagccggctgtctccgccagaggcggctttccaaaggatgctggcgatggagctgcggagccctgaccatccccgagcagaataccctgacttctctccctccccagggccggtggctggactctgaacaactcccttcagtaaaggggccagtcttcactggcagtggctggtacttggctctcagcctggagtggcagctctgctagcagctgggttcactcccacttcatcctggctgaaagcagtgctgtgctttgaaatgcagccaatgaatacccagtctgattacccagatttgggcagaccagcagtgctcgccagagtggtctggcctgctatgggggatccaggtggtgttacatgtccatttcatgttttgggggcttttagccccacaaaacaccttcagtagagccttgattaaaaggaaacctgcaga

SEQ ID NO: 920 - DNA, 1085 bp, Homo sapiens
aacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaa

SEQ ID NO: 921 - DNA, 493 bp, Homo sapiens
ccgcagccagcaccgggcggagagggctaccatggggaaaatcgcgctgcaactcaaagccacgctggagaacatcaccaacctccggcccgtgggcgaggacttccggtggtacctgaaggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaagg

SEQ ID NO: 922 - DNA, 1667 bp, Homo sapiens
gacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagaggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaaggtaccttcgtgtatattcttctgatttttatgtgaccatagctatgatgtaaagacaatactgtccttcagagaactggtattaagataaacttaaggatcgtttctggtgtagaagtcttcaagtgtagacttaaggaaaaaatcccactgtccatgaaatgatggtaggaaaacagactttgctctgtacagaagtaagtaaaagtaggaatagtttccatggatatttttatttttattaacttttttcagtttctttttattcaaagaaacaaaattcaatctctgataatatttgaggtaaagttcctttccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagtagaaggaaagataagaatgaggcagcagattttccctcctggaattacacataaaggacactaagcaattttcaaggtaaatgttgccttgttgttggtctttggcatgataagattctttatttaaatatgagagaatttttttttatcctttatattctctcaatatcagaactcctgaattctgaagattgccctcctcccattaataggattgtatggatgtaagatggaataaaatactagttcttcattttg

SEQ ID NO: 923 - DNA, 3468 bp, Homo sapiens
tgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacctaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataagttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatcttttttaaaaaaaatattttccatgttatagggaaaggacaaagagacttttatcagtttgctttttgtcttgtggctgtacatgctgttggcatagccctaacacagttgttcacaagttttcttttttcttgttgcaattttccttcactttgttgtaatacaggtgcacaaatcttaagtgcacagctgggtaaacttttacagtgttcacctgtgtaactaccacccggatcaagttagagaacacttccattgccacagaaggcttcctataggtgtctgttcccagttgatacccatgaccctcaccacctccagaggtccccactgttttcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacggggtatatttctgtttagctttagtaaattctgccagtttacactcctaccagcaatgtatgagagttttagttgttcaccattcataacactgttagcagcccttttcgttttagactggttggctgttcacaaattttgatattccttaaagcattaaaacattttaataaatacttataaataggta

SEQ ID NO: 924 - DNA, 795 bp, Homo sapiens
ttgggccatgtggtccgcatcgtattccactaggtccccgttgtacaccaggtgtgctgggatatgcagctatgaagggaagggtggaatgtgttccatccgtctcagcgaaccccttttgaagttgaggccaagaaaggatcttgtagagcataattttataagactaaaattcattaatgacagtctagttcttctgatggaaattgttttttaaaaaaattatggaggatcatgaaaaagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagca

SEQ ID NO: 925 - DNA, 3559 bp, Homo sapiens
caccaacaagcaatcgttcatgagaaagccgtgcacccgctgcagttgggccatgtggtccgcatcgtattccactaggtccccattgtacaccaagtactgtcccggcgtctccagcagatgcctgcagccttccaccttctcaagcagggtggtgagagtgcgctgctttccttcctcgcctggaccggagccgtcgcgggaggcacccccgggggtggagaaaaagccggcctggcctcggaggtggtctcggccccccgccccaccgactccctcctcccctccagaggcggcggcggctccggcggcagcagcggcaggcagcaacgtaagcgggatgctctccaggctgcttttctgctcggtcagcaaatggctgagctggtacatctcgctctccaggtaggagatctcgcgggccgtctctatgaactgccggtagttctggtagacgttgcgcttcaggttctgcgccgtctcctccgccagcgcctggatgcgctgccggtgctcctggaggtcccggtccccatccgactgctgcgagagctgcttcacgtacagccgcgcctcaaaaccccctgactccagctgccgacgcaggcggctcgccccactgtccgacatcgccatcgccatttctctccgggtctcacgcactcactgtcactatcggcgccgcagccgccgcggctgtctagacccacccaaggccaaccgagctcctgggctgaggaagcaggaatgggaacgagacgagtacgcctgcgccgggtctgagcgtcagacactgcgcctgcgcaagtgggccgagcgcagacattgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaaggtaccttcgtgtatattcttctgatttttatgtgaccatagctatgatgtaaagacaatactgtccttcagagaactggtattaagataaacttaaggatcgtttctggtgtagaagtcttcaagtgtagacttaaggaaaaaatcccactgtccatgaaatgatggtaggaaaacagactttgctctgtacagaagtaagtaaaagtaggaatagtttccatggatatttttatttttattaacttttttcagtttctttttattcaaagaaacaaaattcaatctctgataatatttgaggtaaagttcctttccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagtagaaggaaagataagaatgaggcagcagattttccctcctggaattacacataaaggacactaagcaattttcaaggtaaatgttgccttgttgttggtctttggcatgataagattctttatttaaatatgagagaatttttttttatcctttatattctctcaatatcagaactcctgaattctgaagattgccctcctcccattaataggattgtatggatgtaagatggaataaaatactagttcttcattttgagaaaactgtacattagtttaatgtttgttactgtatttcttttgagttgaggcacttacataacaatcttctttgcttttttggcagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacctaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataa

SEQ ID NO: 926 - DNA, 2282 bp, Homo sapiens
gtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagaggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattacaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacctaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataagttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgc

SEQ ID NO: 927 - DNA, 2761 bp, Homo sapiens
atgtgggggtccccagcacttgcctgggccgtctggcttgcctgtgttcagcccacggtgttcccatggagcctctccttcaggtcagacacggacaagccaagctctgcagcagaagttttaacagaagcatcttcttgttggacagacacagttgagtgcttctcagactacatgaccctgtggatcccaaggagccacgtggaggggctgaggcggtggctggccaggaccttgcacttgccaggcacctggaggtcccctgaccacctggattcttctcttgctaaatgtggctacttcctgcatctggcttcagacggtgacttcctttttcgagttcaatactcggcctgctttgtgcagaaagagaaagcaaattacaggctggaaatcagaatatttcagaaaggggtgatggggttggagcggagtgatcgctacataatgaagtgtccgatgctaaggtcaaggctgggccaggaaagcgtccactgtgggcccatgttcatccaggtctcccggcccctgcccctgtggagggacaatagacagactccatggctgctgtcccttcgaggggagctggtggcttctcttgaagacgccagcctgatgggactgtatgtggacatgaatgccaccactgtcaccgtccaaagcccgagacaaggccttcttcagaggtgggaggtgctgaacacctctgctgagctcctgccactatggctggtgagcggtcaccatgcctattctttagaagctgcttgcccaccggtgtcattccagccagagtcggaggtcttagttcacatccccaagcagagactgggtctagtcaaaagaggttcctacattgaggaaaccctgagcctcagattcctccgagtccaccagtccaacatctttatggtgactgagaacaaggactttgtggtggtcagcattccggcggccggggtgctccaggtccagcgatgccaagaagtcggaggaaccccgggaacacaagctttctatagggtagacctgagcctggaatttgccgagatggctgccccggtcctctggacagtggagagcttcttccagtgtgtgggttcaggaacagagtcgcctgcctcaactgctgcactgaggaccactccctccccaccatccccaggaccagagacccctccagcgggagtgccacctgctgcttcctcccaggtgtgggctgcaggaccagctgcccaggaatggctttctcgggacctcctgcaccggccttccgacgcactggccaaaaaggggcttggaccattcctgcaaacagccaaaccggcgagaagaggccagacatctgcctccattctccccagagtggtgcaagctcagcgaggtccccagcctcccccaggggaagcagggatccctggacaccccacacctccagccacgctcccctcggagcctgtagagggtgtccaggctagtccctggcggccacgtccagtcttgccaacgcacccggctctgaccctgcccgtgtcctcagatgcctcctctccttcaccgccagccccgaggcctgaacgacctgaatcacttctggtctcaggaccatctgtcaccctgactgaaggtctaggaactgtgaggcctgaacaggaccccgccaagtctccaggaagtcccctcctgctgagaggcttgtcaagcggggatgtggctgcacctgagcccatcatgggggagcccggccaagccagtgaggagttccagccattggcgaggccctggcgggccacactggctgcagaggagctggtttctcaccgttctcccggagagccccaggaaacgtgctctggaacggaggtggagaggccacgccagacagggcctggtctccccagggagggggccagggggcacatggacctttcatcctcagaaccaagccaggacatagaggggccgggactctccatcctgccagcgagggatgccacattctccaccccaagtgtgaggcagccagaccccagtgcctggctgagttcaggacctgaactcaccgggatgcccagggtgaggctggcagcgcccctggcagttcttcctatggaacctctgccaccagaacctgttcgcccagcagctcttctgacacccgaagcctcatctgtgggagggccagaccaggcccgatacctggagtcagcccctggctggcctgtgggccaggaggagtggggggttgcacacacgtccagccctccatccacgcaaaccctgagcctgtgggctcccacaggagtgttgctacccagcctggtggagcttgaataccccttccaggctggccggggggcctcactccagcaggagctgacagagcccaccttggccctcagtgctgaaagccacaggcctcctgagcttcaagacagtgtggaggggctttctgagaggccctcacgctgagcctccatggagactccaggcagccggtaccccgctggcttggacagccccagtgaccctcagtgacccagctgtccccaggctccctggcttagatgcccagctgtggctgggtacagtgttctgggccggaagagcactcactcagtgcttccctggaaaggtggacccccagacgcccacctccaggcagacccatcactggaagtgggatttgaaatgcagccaagaagaggagaccgtcggcaacgcccgcccggaacaagaaataaataaataaataatcagg

SEQ ID NO: 928 - DNA, 2707 bp, Homo sapiens
atgtgggggtccccagcacttgcctgggccgtctggcttgcctgtgttcagcccacggtgttcccatggagcctctccttcaggtcagacacggacaagccaagctctgcagcagaagttttaacagaagcatcttcttgttggacagacacagttgagtgcttctcagactacatgaccctgtggatcccaaggagccacgtggaggggctgaggcggtggctggccaggaccttgcacttgccaggcacctggaggtcccctgaccacctggattcttctcttgctaaatgtggctacttcctgcatctggcttcagacggtgacttcctttttcgagttcaatactcggcctgctttgtgcagaaagagaaagcaaattacaggctggaaatcagaatatttcagaaaggggtgatggggttggagcggagtgatcgctacataatgaagtgtccgatgctaaggtcaaggctgggccaggaaagcgtccactgtgggcccatgttcatccaggtctcccggcccctgcccctgtggagggacaatagacagactccatggctgctgtcccttcgaggggagctggtggcttctcttgaagacgccagcctgatgggactgtatgtggacatgaatgccaccactgtcaccgtccaaagcccgagacaaggccttcttcagaggtgggaggtcagtggtgggcagcaggctctgccaggagtgtcattccagccagagtcggaggtcttagttcacatccccaagcagagactgggtctagtcaaaagaggttcctacattgaggaaaccctgagcctcagattcctccgagtccaccagtccaacatctttatggtgactgagaacaaggactttgtggtggtcagcattccggcggccggggtgctccaggtccagcgatgccaagaagtcggaggaaccccgggaacacaagctttctatagggtagacctgagcctggaatttgccgagatggctgccccggtcctctggacagtggagagcttcttccagtgtgtgggttcaggaacagagtcgcctgcctcaactgctgcactgaggaccactccctccccaccatccccaggaccagagacccctccagcgggagtgccacctgctgcttcctcccaggtgtgggctgcaggaccagctgcccaggaatggctttctcgggacctcctgcaccggccttccgacgcactggccaaaaaggggcttggaccattcctgcaaacagccaaaccggcgagaagaggccagacatctgcctccattctccccagagtggtgcaagctcagcgaggtccccagcctcccccaggggaagcagggatccctggacaccccacacctccagccacgctcccctcggagcctgtagagggtgtccaggctagtccctggcggccacgtccagtcttgccaacgcacccggctctgaccctgcccgtgtcctcagatgcctcctctccttcaccgccagccccgaggcctgaacgacctgaatcacttctggtctcaggaccatctgtcaccctgactgaaggtctaggaactgtgaggcctgaacaggaccccgccaagtctccaggaagtcccctcctgctgagaggcttgtcaagcggggatgtggctgcacctgagcccatcatgggggagcccggccaagccagtgaggagttccagccattggcgaggccctggcgggccacactggctgcagaggagctggtttctcaccgttctcccggagagccccaggaaacgtgctctggaacggaggtggagaggccacgccagacagggcctggtctccccagggagggggccagggggcacatggacctttcatcctcagaaccaagccaggacatagaggggccgggactctccatcctgccagcgagggatgccacattctccaccccaagtgtgaggcagccagaccccagtgcctggctgagttcaggacctgaactcaccgggatgcccagggtgaggctggcagcgcccctggcagttcttcctatggaacctctgccaccagaacctgttcgcccagcagctcttctgacacccgaagcctcatctgtgggagggccagaccaggcccgatacctggagtcagcccctggctggcctgtgggccaggaggagtggggggttgcacacacgtccagccctccatccacgcaaaccctgagcctgtgggctcccacaggagtgttgctacccagcctggtggagcttgaataccccttccaggctggccggggggcctcactccagcaggagctgacagagcccaccttggccctcagtgctgaaagccacaggcctcctgagcttcaagacagtgtggaggggctttctgagaggccctcacgctgagcctccatggagactccaggcagccggtaccccgctggcttggacagccccagtgaccctcagtgacccagctgtccccaggctccctggcttagatgcccagctgtggctgggtacagtgttctgggccggaagagcactcactcagtgcttccctggaaaggtggacccccagacgcccacctccaggcagacccatcactggaagtgggatttgaaatgcagccaagaagaggagaccgtcggcaacgcccgcccggaacaagaaataaataaataaataatcagg

SEQ ID NO: 929 - DNA, 2227 bp, Homo sapiens
aatatactagagtttctcttcactactttgtctcaccgtgattacagagaagttacaaatatcattactagtagaagactttaatacacctctgtcagcatgttgacaaggaatccaaaaacaaagagtagtctccagattctgcaagacagtgtgaaatggcaccacatggcacataaagttaacagcctattggatgcatactcaggcctgttaagtaatgaatccatgatcctggctgtgaactccagctttgtggatcccttactgcagtttgaatctcagttgaagataatagagtcatcctttggaatgctagttgtcatgccaagtcttgacaaagtaaaagaaatggggagcagttatgagtacattgaggacatggagaatttataccacaatattttaaatatatatgagaacattcttacgagcttggtgtctaaagacctctacaaactacagatcttaaaggaaatgctcgtgtggatgagtaaagatagctcatatctgcaagagagaataatggtgatcatcaacaaggtgttaagatttacagtcacaaaagtcagaaaatacataagtgttgatgctccatgtttgggtctcctggcagcagagctgtctcttttgtgttcccatgaagatccctcgattgtaaaacaagcatcattgggaatgtgtcacctcctctacattgcacggtgtcagaacgatattggaacaaataagcctacaaacggtaaaagtcatagcctccagtttccttcttctgatgtagaatttctacccaaggagtttcaacaagacgaaagtaaaatagctcagagagtagggcaaaccttactgcctcccttgctgactgactttgtgcagagtctcctgatgaaactctcttcacctgatgataaaatcgcatctgatgcagcatccatactgatatttactctggaatttcatgccgagaaggtcaccatggtgtctaagatcgtggatgctatttacaggcaactgtgtgataacaattgtatgaaggatgttatgttgcaggttatcactttgttgacatgcacttcacccaagaaggtcatctttcaacttatggactacccagttccagcagacgacactctgatacagatgtggaaggcggcatgttctcaggcgagcgtggcccctcacgtgctgaagacaatcttattgatactgaaaggaaagcctggggaaatggaggacaccgtaacggaagggaaacgtttctctcttgatattaccaacttgatgcctttggcggcatgccaggccctgtgcacctttctgcctcttggttcctacaggaaagcggtggcccagtatttcccccagctcttgacgactcttatgttccaagtcttctacaacagtgagctgaaaccgatactcaaggacagggctttgtatgcccaggatgccctgagagttctgctgaattgttctggactgcaacaggtggatattactctaatgaaggagaatttctgggaccagttatctgaagatctgtgttactatcatggagtctgctttattgctaaaactctcagtgaatataactttccacagtttccggagaccctgagttatctctataagctctcagtagaaggtcctagaaggtcagaagacactgtcatcgtattaatattcctcactgaagtgagttttgtagactgtgaacagctgtgttctcatttccttttcttacccaaatttaaatcaaaattccagtttctcgtatctctccctctgaatgttggttcttaccaagacttaagatcatgaaagatatctgaagtcggatggggagaggtgtggagttagatctgggttatggaagagttgtcccttcagctttccccagcagttggtttttctctgtttctaggggtgtgaatttgtacaaaaactaattattttttaggaccagtttatatatttctgcatgattgttaaagtatattgagggataattgggtttaataaagatggtagttaacatctgggatctaggcagtacttctgaccatctagagggagaaaggaactggctgagtaactgggtaaaatgaagatgtggaaccatattactttgtatatcaatattgtgccatgtattgtaatactataatggaatcaagcaaattgacaaacttttgtttacaaaaaataaaggctttataacctgaaa

SEQ ID NO: 930 - DNA, 3165 bp, Homo sapiens
aaagaatttgcttggttgataactacctagagtattttacctttggctaagaggtaatatactagagtttctcttcactactttgtctcaccgtgattacagagaagttacaaatatcattactagtagaagactttaatacacctctgtcagcatgttgacaaggaatccaaaaacaaagagtagtctccagattctgcaagacagtgtgaaatggcaccacatggcacataaagttaacagcctattggatgcatactcaggcctgttaagtaatgaatccatgatcctggctgtgaactccagctttgtggatcccttactgcagtttgaatctcagttgaagataatagagtcatcctttggaatgctagttgtcatgccaagtcttgacaaagtaaaagaaatggggagcagttatgagtacattgaggacatggagaatttataccacaatattttaaatatatatgagaacattcttacgagcttggtgtctaaagacctctacaaactacagatcttaaaggaaatgctcgtgtggatgagtaaagatagctcatatctgcaagagagaataatggtgatcatcaacaaggtgttaagatttacagtcacaaaagtcagaaaatacataagtgttgatgctccatgtttgggtctcctggcagcagagctgtctcttttgtgttcccatgaagatccctcgattgtaaaacaagcatcattgggaatgtgtcacctcctctacattgcacggtgtcagaacgatattggaacaaataagcctacaaacggtaaaagtcatagcctccagtttccttcttctgatgtagaatttctacccaaggagtttcaacaagacgaaagtaaaatagctcagagagtagggcaaaccttactgcctcccttgctgactgactttgtgcagagtctcctgatgaaactctcttcacctgatgataaaatcgcatctgatgcagcatccatactgatatttactctggaatttcatgccgagaaggtcaccatggtgtctaagatcgtggatgctatttacaggcaactgtgtgataacaattgtatgaaggatgttatgttgcaggttatcactttgttgacatgcacttcacccaagaaggtcatctttcaacttatggactacccagttccagcagacgacactctgatacagatgtggaaggcggcatgttctcaggcgagcgtggcccctcacgtgctgaagacaatcttattgatactgaaaggaaagcctggggaaatggaggacaccgtaacggaagggaaacgtttctctcttgatattaccaacttgatgcctttggcggcatgccaggccctgtgcacctttctgcctcttggttcctacaggaaagcggtggcccagtatttcccccagctcttgacgactcttatgttccaagtcttctacaacagtgagctgaaaccgatactcaaggacagggctttgtatgcccaggatgccctgagagttctgctgaattgttctggactgcaacaggtggatattactctaatgaaggagaatttctgggaccagttatctgaagatctgtgttactatcatggagtctgctttattgctaaaactctcagtgaatataactttccacagtttccggagaccctgagttatctctataagctctcagtagaaggtcctagaaggtcagaagacactgtcatcgtattaatattcctcactgaacttctgaataacttcttcaaggaccctttaccagaagaatttttggtcctcttcataaactggatcaatgattccaatcctgtagttagcagactgatccttcatagaattgtccacatgtcaccaattatcaataagacagaaaatgtcagcagtatattaatagccatcctggatgccttcctttccaaagacgataatgttgtacttcaggccttgctcacccttagaaggcttttaaacgaactggacaaagtgacctactctttgggtaccagaattggttccagctactgtactctgatggatcatattaatggaggcattcgaagtatggcaattcgacactttggtcaattagttagggatatgagacagtacacatggatggtgaatgatgtggttctagaaggcttggtgcccctaatcctatttttggaggatgatgataaaagagtagctgaagcatgtaaatatacattaaaaatctgtacctcacaattaaagtggtcaacatcacgtttgctcaaagatgaaaattacagttttgagatggtggtgctcaatatctgtaacaatcttattatttctcataggaactacattacagatttgacatctgataccttacgattcctgtggagccccagaacatatcttaagagggcatcggttattttgataggatatttggcaaaatcaggtggtcatttactgcttagagatgaaatcgaagtcatgcttgatgttattgaacgactgctccgagatgaagaccctatgatcaaacagttggctgaaataacctatgatatttttaagaaaaaagcccataaactgacctctgcacctcttaaacaaaacttccaaaaattgcttaaattattctacatcaaaaaattgaagcctctttacaattataactcacccaatggccagatagacagtcctacagacagtaaagatgtcaagaatgataaggccttatagaagagaatgatgatgacattcatcattcataaacaatgggaagtccaacaatgtcttggagctgaccttagaagaagaatgatttttctttccctcctgacaacttgagtctgtttgtagatgcttttctgaaaaattctggaagcttttactgttacttcttaattctctattcaaatatagaaatctgagagaactagtgcctctgtatgtctgacagtgatcagaagccctatttcatcaaaaccactaagacaattgaaaataacataagcaaagtgtttgatgagaagctctgggaacttgattcagtccggaagctctactgagcaccttctaagtgccagatactgtgttaggcagtggggacatttggatgatatagacaaggttcctgatctcaggatgggcacagtctagtgaca

SEQ ID NO: 931 - DNA, 687 bp, Homo sapiens
gatgcctttggcggcatgccaggccctgtgcacctttctgcctcttggttcctacaggaaagcggtggcccagtatttcccccagctcttgacgactcttatgttccaagtcttctacaacagtgagctgaaaccgatactcaaggacagggctttgtatgcccaggatgccctgagagttctgctgaattgttctggactgcaacaggtggatattactctaatgaaggagaatttctgggaccagttatctgaagatctgtgttactatcatggagtctgctttattgctaaaactctcagtgaatataactttccacagtttccggagaccctgagttatctctataagctctcagtagaaggtcctagaaggtcagaagacactgtcatcgtattaatattcctcactgaacttctgaataacttcttcaaggaccctttaccagaagaatttttggtcctcttcataaactggatcaatgattccaatcctgtagttagcagactgatccttcatagaattgtccacatgtcaccaattatcaataaggtcgactgaatttaagcacgttccattttctgtaattctacactccaaagtatcttgcaaaatgctgacagtgcaaatgttctataaatcattacttttataatacatccaataataaatcgttgtttatctaa

SEQ ID NO: 932 - DNA, 2483 bp, Homo sapiens
acccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggtgagtgattttatcaggtcctggggttgaacaatctggatgaacctactgatgagttctgacaaggacgccttgaatgtatgtggtgttgctagcccattagagcgcttcactgtctctcatttatccttgtcaaagtaggatttagtaaactgcccaagatcaaacaactgcctgagaactgaattaggaagtttctccaatcttccacttttcaccgacactctaagtgactagtggaaaagctgcagtttacatttccaagaaaagacttctaagagtgctgctacagcagcgtagtctgggtctgtatagcctgctctttgacataccacgtaagatagagcaccgtaattatgaataagggatgttgactttgttgctttatacttgtttgttagcttttgttcaaatgcctttttctctgtctttgagttactgtttcagaatggactctttttgtcttagcctgttttcttgggctcctagtgcacttgtacatgctgtaaaatggtcatttgttctggccaccgatctgtatctgttgaatgcctctttgtgccaggcatgtgggtgtcttaggtattggtgtacagctgtaatcacactaaagatatccctgcccttgaggagcttcattgtagggagagaaacaccccaaaacatacaaatggataagtaagatgatatcaggtactggcaagtattgtagagaggctgaaagagagcattgtgaaggaaaaccacagggagaaggtgagctgggaaattagtctgaggaggtgacatcggagctgagaactgaacaaagaagaggggcagcctggaaagagctggtagcagaacattccttgcagaagaaaccagtgcaagggccctgaggcaggaaggcagtagcatgtttcagggaccacaggaaggcgtatggggtggggggtgtgcatggcaggcgaccaggagtttgcaggccagactgcagtggcctggttggtggtactgtgatgcttgttggtaagcttgactatttatagtacctttctcttactttaaatgtaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtata

SEQ ID NO: 933 - DNA, 1372 bp, Homo sapiens
gtcgcggaacccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaaggctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagt

SEQ ID NO: 934 - DNA, 1424 bp, Homo sapiens
cggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtata

SEQ ID NO: 935 - DNA, 1432 bp, Homo sapiens
gtcgcggaacccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtata

SEQ ID NO: 936 - DNA, 795 bp, Homo sapiens
gggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaaggctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgagg

SEQ ID NO: 937 - DNA, 584 bp, Homo sapiens
gccgccgcggagccggcgtccgcagcggctgcgcatctcgggcctgcagcggggcgcttggcgggcgggggccgggggagagcctgtttgcgcagtacccccggagggcggaaggccgccgagagaaacagcaagtgacagagcagaggaacggctggcccagccaatcctggagctgctgttgcagcacttgttccccaaacaagtgctcctacattctgatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagt

SEQ ID NO: 938 - DNA, 726 bp, Homo sapiens
gaagaataagagctattattattctttatgtcttatccttttttttttttaaaaaaaaaaccaagtttccttctaagggaaataaacaccaaaggtaggattccaaggaaatgactcacagcggctggcagggctctggcggggctggcccgggcccccgcgctccagcccgcagcagatgtcggcccggccttccctccctcccttgccggccaaacccgctggaagcccgcggttgcgggagcgccctgcgcccgtgggacctggcggcgaggacgcctattccctgcttctgcgaccacagctgggcactcggaaagttgctagggccgaagaggcgggaggggaggaagggaagcgagaggcggaggcgtggaccaggcgggcagcagcctcagcccgccgaggagtgatcctccgactgtgaaaaaccagacctctggctgcctggctccctaggaatcaagaagacgcacagactgaaaatcaagggaggaaggaacaagatcaaggatgaggattagcatctgcaaattgaactctatctaatttgcatgtttatttcttagaattgtaattaaatttgtgtaataaatgttttccatttcatttgtacacttaaaacttgggtgactgacatgcagttaagtgaatttcctttttttaaaagcaaatgtagattattcaataaagcagcaaaccaatattaaacataattagaactaa

SEQ ID NO: 939 - DNA, 2116 bp, Homo sapiens
ctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcagtgaaacaaagccgtagtccagtttctgtgttttcctgggacaatgaaaagaatgacaaggactcctggagtcaacttttcactgaagattctcaaggccagcgggtcattgcccacaacactagagctccttttcaagatgtaaccaataactggaattgggacttagggccgtttcctaacagtccttgggctcagtgccaggaggatgggccaactcaaaatctgaagcctgatttgctctttacccaggactctgaaggtaatcaagttatcagacaccaattctaaatgtttgaagctttgtttctaaaagtaccttgaaatgatagagatgtaggaaaatatagttgtgggtggagagaggagtgagtttgtttaggtgggaaggtggcatgggatgaagttgtcattactgagcatcttctctgtgtaaataaagggcagtaccattgttaagacagtgggattggcatcatggctttccctcaggaaggtggtggctggtaaattccctgaatgagtctatgatgaacactgaggcagcacagtgggtatttatctctatgaaagtgccttttactcagcctgcacagagccatctctttgcccttccagatgtctgactgggaccttgcttatggatgtgtttttttttttttttttttgagatggagtctcgctctgttgccaggctggagtgcagtggtgcgacctcagctcactgcaccctctgtctcccggattcaagcgattctcctgcctcagcctcccgaatagcagggactacaggcatgcgccaccacgcccagctaattttttttggatttttagtagagacgaggtttcaccatattagccaggatggtctccatctcctgacctcctgatccgcccacctcagcctcccaaagtgctgagattacaggcataagccaccgcgcccagccagatgtgtgagcttttaatctctggctgatcttaacccacatcagcctaagcttgggatgattactcttgacccttttttttcagtgattagcaaatctccccacaacccaggtgtggagagaagagaggtagaatggtgctagtttcctattttatttttgtggtaactgtacagcactttaaagttatatactctatgtttaaatatctcccttaaaaagcctgagctgtacaacaatctggatgtgactctgttacccttttcccacaagataggagggaatcccctttgtaaaactatgaatccaaataaatgtttacaaagtg

SEQ ID NO: 940 - DNA, 1336 bp, Homo sapiens
ctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcagtgaaacaaagccgtagtccagtttctgtgttttcctgggacaatgaaaagaatgacaaggactcctggagtcaacttttcactgaagattctcaaggccagcgggtcattgcccacaacactagagctccttttcaagatgtaaccaataactggaattgggacttagggccgtttcctaacagtccttgggctcagtgccaggaggatgggccaactcaaaatctgaagcctgatttgctctttacccaggactctgaagtccaagctctagcttgtcagcaagactgttgcagaagatctatccttaagaggcagaaacatctgcggtgaggaaggcagctattgaaggtattccaggagcatgagactgagtttgcagagctgagggttgtcaatttccttttctactgatatcttcttcctttagagcaaacttcctccttaggacctcagagataagcacagcagggtcttcctccttcaataaactccggt

SEQ ID NO: 941 - DNA, 386 bp, Homo sapiens
ttgacaaagaacccaggaatggcgttaaagacttctttgggcagtgtccaatttatggagcaattttgttggccacatctacggagcttttgtgaaacttgcgtaggctcatggagtatccaaatgaggcaacatcaccatcagtcctccttccctggctcactgcctcaggaaaccaacctgaccctgaaggtatgtaagcctcaggccccacaaaagttggatccaaccttgagcagttgctttttcattgagtcctgtggagctcaggttcctgtggagggtagcagaagggaaacttcaattacagtataactggtctgatctgttctacatattaaagttcatgctattttctttgtgataaataaagactgttctgctgc

SEQ ID NO: 942 - DNA, 490 bp, Homo sapiens
ccaggctgagccatctctgaggaatgtggctttggcaggacatccagtgctgccccgctcctccctcagccccgcccagggccctggagccgggccgggctcctcctcctccaggggaagggctcggggcaggaatcccttccctttccccaccccagaagaagccccagagcgtagggatatgcgtacggcagaaagggagacagaaggcagggctagagaaagggaacaggaaaaaagagcttcgacaagccaactgcccttcgctcaggccccagcggaaaggcgcagatacccggagacttcccagagagactcgacccaccaaaaagcgcaccgcggccgcgcagcccttccttcagctctggaacccagcgccccacacctcaaatgggagaactggtgacctctagtggcccatgaccagcctgcagggcctggggctggcggggattctctgacccaaactctcctgggctctaatgctgtt

SEQ ID NO: 943 - DNA, 370 bp, Homo sapiens
gccagaagagggaggaaaggagatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatttcagaa

SEQ ID NO: 944 - DNA, 4271 bp, Homo sapiens
gagacagggtttcagtatgttggccaggctggtcttgaactcctgacctcaagtgatctgcccgcctcggcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatctcaaattgaaaaaaaacctaggaaaccattggattctgttggtctcttagaaggtgatagaaataaaaggtaatttattttaaaatgcttaatactttgttctgtttaatgatgtttctagtaggacacattttataattgacaggaataaatttattctgccttattatttagttccacagcacaatccaatgaatggtccaagactgcttagccactagatatcacatccagaccttgagtattgttaaatggagagaaaggcatggaaaaatgaatagagggaatacaatttttttttttagtaaatacacacatttacttacatgacaacatggacatgaaaaagtagcttttctttggataaagttctcatttttctcatgaacccttccatctctgtataatgaaaaaaatcattaatccagtgtgtttcaaactttgtttgaatcaataatgaacaagcactttaggtttaactcagtttaaaaattatatcctgtctctgcctgaccacactattctatcctcttaacaaagctggggccaccctatgttggcatgaagctgccctgtggagcttcttccagaatttcaacataggacgttgcaaatacctctctacctttggtgttctcctcaacctacgtaataatacaactcgtccccactcaaaatccaaagaggcatatatatgactctcttgcttccactcctactcttgctgttttctcccacaaaccaggcaggacgggatgatcttgtcggtttgaaaagtctgtgggagagaggttggtgcagaagttggcagtgacttccagggataaaaggaggcagacaagaactgacaagctgtaatcagccccatgaacactaccctgaactgtgtttattttcagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggtaataagcatatcatctattgttaagtaaatatgtgtagtcataagacttatgggaatcacccatatattttagtgaccagaatctttgataaatcctttttacctcttggtttcatattccaaagtgataacagcacttaagttcttaatgcactttgcacaactcccaaaccagggattcctttataccagctgaaaattcagtgtttttctttatgaagaagcctttatcaaatttgcttgattataatagaactgtagaataaaaagaattttttaaaaatggctgtaccaatctagcagaatgcagtggtgtgcacctgtaatccccgctactctggagtctgaggcaggggaactgcttgagcccaggcatttgaatccagcctgagcaatataacaagaccccagttctaaaatgatgggaccatgaccatgtgtcaatttttctaacaatctgttttggctttttcaaccagaaagtgcatttattaaaggctatttagtaactcatgctctctagagaggcaatatggctcgaaagctgtctagtcaggaatcacctaattatatagccccagactgctccactgaggcccatgctattgtcacagataaaagtttacaactctgatgctgagcagggaatactctaagacatttgctactgctgtcattcaaagctagatgtaactcctaccaccctcactagaatagttttcccaatactttttcacagtgcttgctttctctgaactgaagacttcataggtgtatctgaatggcagagcctagggcaaatgcctatgtcctaaccgcaaagaagctgataaacatggttcttgcctctacctaagggtacatagacttgtcaagtggaaaattccctaaggtgttggacagaccaaaagcattacaaacatccattactatggctaaataggtaatattggcatcaccagtggattgcaaaactagatctttgtcatcttttcagtaatcatagcagacttggatattactgcgataaaaatgtctattcttaagtcaatctattactttggctattttattccacaaatatatattgagcactttttaggtgtcaggtattgtgctaagtattagggtacaataataacagttgtagagataatttttaattttttgaattacttactagaatatccagatttgtaattttggcttgtaatcagttatgtctcttctgaactttgactcaatccattttttggtatgctttttaatttctagaacatggaaacctaagaaatgccagaacaaccaccttatttctcaatgacagtaccccagatatttaacaaatatattaattttttcgtattccaatttatttcaaaaaacatttaaggccaaaagttcaagttttatcactaacatctctatagaatattaagataagaaggatgtatgttacatacaagtacagtattttcatgtatttgaataatgctactgttcatattaaatatttgtatgtagtcatttttagaatattttacaattttatttacatgttttaaaatatatggagctttcttgactcaatgaacttatgactaattattcttttctttaatctacaggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatccttaa

SEQ ID NO: 945 - DNA, 1599 bp, Homo sapiens
gccagaagagggaggaaaggagatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagagccagtagaagaacatctaaaatcaagatctattagaccctatctttatcttaaggatacaactgagatggaaaatgcagggcctttgaatgttctatattcacagcatagacaagcatgtagaagatcactgggttctacagacttttctcctatgttcaacattcagtctaatgctcataaaaaggaaaaagactctactttatttacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttcc

SEQ ID NO: 946 - DNA, 2053 bp, Homo sapiens
ataggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatccttaatctaaataattttggtagcaaatcctataaggtattaaacattttaaggtatattattacattgctattttactgtttctcattaacccaaacagtttaaaggcagaattccacttagaaacaagttgcattttgaaagtttatttgtaatccatttgtttggaattcagaaatgtatttcacataaaaataatcttggaagtaataaattccaaaatt

SEQ ID NO: 947 - DNA, 2143 bp, Homo sapiens
gagacagggtttcagtatgttggccaggctggtcttgaactcctgacctcaagtgatctgcccgcctcggcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatccttaatctaaataattttggtagcaaatcctataaggtattaaacattttaaggtatattattacattgctattttactgtttctcattaacccaaacagtttaaaggcagaattccacttagaaacaagttgcattttgaaagtttatttgtaatccatttgtttggaattcagaaatgtatttcacataaaaataatcttggaagtaataaattccaaaatt

SEQ ID NO: 948 - DNA, 950 bp, Homo sapiens
gggtttcagtatgttggccaggctggtcttgaactcctgacctcaagtgatctgcccgcctcggcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagagccagtagaagaacatctaaaatcaagatctattagaccctatctttatcttaaggatacaactgagatggaaaatgcagggcctttgaatgttctatattcacagcatagacaagcatgtagaagatcactgggttctacagacttttctcctatgttcaacattcagtctaatgctcataaaaaggaaaaagactctactttatttacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataatttt

SEQ ID NO: 949 - DNA, 1386 bp, Homo sapiens
gccagaagagggaggaaaggagatgagatttcatcatgttggccagcctggtctcaaactcctgacctcaagtgacccgcctgcctcagcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttcc

SEQ ID NO: 950 - DNA, 1343 bp, Homo sapiens
aaagcggcgagtaagatggaagatgaggaggtcgctgagagctgggaagaggcggcagacagcggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacgg

SEQ ID NO: 951 - DNA, 3636 bp, Homo sapiens
cttccaagatggctgccctaatgtacacttgggaccttgcctggcgcctcttccgggcttggcagcgggcggggtccattgagtaaagccttgcgtgcctgcgcccgcgacggaggcgcgcttcaaagcgcaggcgcggggagggggtgggggaggagggaaagcggcgagtaagatggaagatgaggaggtcgctgagagctgggaagaggcggcagacagcggggaaatagacagacggttggaaaaaaaactgaagatcacacaaaaagagagcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 952 - DNA, 3447 bp, Homo sapiens
gggggtgggggaggagggaaagcggcgagtaagatggaagatgaggaggtcgctgagagctgggaagaggcggcagacagcgggcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttgtca

SEQ ID NO: 953 - DNA, 689 bp, Homo sapiens
aaagcggcgagtaagatggaagatgaggaggtcgctgagagctgggaagaggcggcagacagcggggaaatagacagacggttggaaaaaaaactgaagatcacacaaaaagagagcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgaaccccatgcactgtgacctccccccttctcccccttcccactgtgattggcacatcgacaagggctgtcccaagtcaatggaaagggaaagggtgggggttaggggaaggttggggggaccca

SEQ ID NO: 954 - DNA, 857 bp, Homo sapiens
cagattgttgcaccattagaagctaggttgatccacagacagatggctgaaagtggaaaagaaaaaataaaatggacaaccaccattattattagctcatctcttaagtagaaagaaggtctcgctacattgcccaggctgttctcaaactcctgggctgaagtgattctctcacctcagcctcccaaagtgctaggattacaggtgtgagccattgtgcctggccaagtttaaattttaacctatcaggaaaaactattaaccacctagattttagtattgtgggtaatatgatttaattgcctgggtggaataggaaatcaggtgatatttgaaatgagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataat

SEQ ID NO: 955 - DNA, 830 bp, Homo sapiens
gccccaggcaccctgggcgctctgccctaccggcggcgcctctcactgctcacggaacgttctggaagtttgggaaaccctgagcggtctctgaggacctggtgagcagattgttgcaccattagaagctaggttgatccacagacagatggctgaaagtggaaaagaaaaaataaaatggacaaccaccattattattagctcatctcttaagagttatgaagttgcaactgccctagaaaatcgaagccacaaagttcgatattcagattcagtggaaaatggatcaattatattttctctttctggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataattagacctgttaaattataatattcaaatatctatttaaagacatttatattaatttgaaataataacatatacaattaaaagtgattttattttagga

SEQ ID NO: 956 - DNA, 2096 bp, Homo sapiens
acttggacctgatgcaaggaaacaacctccagccaccttcccccaggcctttagagtgctggtctttgcacagagaagcaccacagaggacagaagcctccaggactcacccttccccatttctggccctaccaggcagccacagaacagccaaccaggcgcaggtggttcctggtctcgtgcaccaccctcaagagaacacacagagacttagaattagagcaggactcagcccattccccagggctcgcctagctgccatcggatccacacatggacacaggtgggtcccgggtatttgcctccctcgctgcctctgccctgccagctgtgccctccacgcttgcccgccccactgcaataatgcagaagcacacagctggctgaggctgggaggcccccttcagagccgtagtgtggagcaccaacaacatgcatgtggctggggctgggtgacgcatgccacctatggtgagcgtggcaccagtcaggctgcagagaggcagaggatagcccacaccagggctctcagtgtggggaactgcccacgctctcatttccagtgtgaattctcttctatctctaagtggagtgaaggaacaggaacattttccccaaggcccagagctgttaaatcaggggttggaggtcagccctcgccacacattagaatcacctggagaagctgtactacactgacatccaagccctgctccagagcaattacaccagaatgtgtggtgggttggagtagaagaagcaggcattggtattctgatatgaggacgggtgagtgccaaggtctcagccccataacaaggtgaggtcctacaggcctcagaatgtggtagcacgtgggaaattgtcctctcttctcaggaggggccagtgttcacacaggcaggggatggagagtgggcctgatctgagaaggcggaacccaaaactcctgaaggggacagtgtgacagaaggttctacttaagggccactgccactgtccttatcccaggggcacctagtgttctcctaaaggagacttctcaatataaccaggtggaacggtagaaagaatccagatttgatttgattttacccctcaaaagccctgaagaatctagattgtagaggcaggcagagccacatacgagtcttgggtctgccacttactagccatgtgatgtgcagaggagacctgttctcagagcctcagtttcctcacctaggaaatagggtgatgatatctactgtatagggcaggtgttgtaggagtaaataagctgagctacagaaatctcccagccaactgcctggtccacccagggacagaaaaccactcctctgctcacaccccttcactcactcctccctctgcctcagggctccacaaagccctgggtcctctgaagcctagaagggccaggccaggccctgggctccaggagctcaggaggggctgttacctcatcctcttgccgtgtgtgactaaggacgcttgatacttctgcacgcactcctcctggaacacctgcaggagtcttttggctaaatgactgaaattcaccctagaacgacagagaaccaaggtgcagatgagctgccagaaccactatgcacaagcccaccatccctcagtctccgtcagtctccgtcaccaccttgtcgtaagtgcccaagccctgcgtccacagcagggctatgtctctgggaaaggaggaaggacggtcacacacttggattgtgaaggttgcagtggccagcaaagcccacatcaacagggagacgtgggagacacacagggggtcctcagggaacacacatgtgctcaagcttagtcctcaggaaagggaagggaaagtgaggcagccgtggaaagaaggtgtgtgagtgcgtgtgtgtgtgagacaaaaaggggtcggggtgcttgtagaactgggggagtgagttcccagataaccattaaatcagggagggcctcctggacgtgagtgtgtccgggaaacatgggagacagaggagcggggggaggcagggaaggttcaggcagagggcagaagcaggaagtggtaagtggtgcatcagtgaggacaactagag

SEQ ID NO: 957 - DNA, 446 bp, Homo sapiens
ggactcggcctatccgtcagcacgcaggctccaccctcgctgaactcacagaggacaatttaggcaggaaccacacactgctatgacatatccaccccaccgtgctttctcgaggagtgatgtcccataccccctgctgagcagccctgtacagtggccactttccctggtagtaggtgacacatctacaaggtggccccagcagccttcagccctagagtctgactgccctggtccaagccatccctgccttgctggcctcctggggcccatgcaccctgttgacattcccctctccactgccctccactcaaagcaccaaagaagacttactcaatgtgtccttatggtgcagagtcccagcaagcagaggtctttgtatctgttgaataaaaaaattcctcatgatgcgtagtaacatcagtgaggaagactgcaccaaggcg

SEQ ID NO: 958 - DNA, 3820 bp, Homo sapiens
agatgcaacgtcctgcctcatgcattttcctcttggtgctttggtcagaacttccccaagtggagtgaaactcaggagctgagaaaccgagtcactgtgaaaagatgggaaattatctcctgcgaaaactcagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatgaataaagcgactacaaatttgaa

SEQ ID NO: 959 - DNA, 4030 bp, Homo sapiens
agacaatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgaggcccctggcagctcgtggttggcaagagcacgaacccgtggtcagatgcaacgtcctgcctcatgcattttcctcttggtgctttggtcagaacttccccaagtggagtgaaactcaggagctgagaaaccgagtcactgtgaaaagatgggaaattatctcctgcgaaaactcaggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatgaataaagcgactacaaatttg

SEQ ID NO: 960 - DNA, 560 bp, Homo sapiens
aatgccaacactgtcctgtttctacaagagacaatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgagaggaaaggccagatgaggacacagcaagcaggcagatggctgcgagctggaagggaagcgtcatcagaaaccaaccctgagggtaccttgatcttggacttccagtctccagaactgcccctggcagctcgtggttggcaagagcacgaacccgtggtcagatgcaacgtcctgcctcatgcattttcctcttggtgctttggtcagaacttccccaagtggagtgaaactcaggagctgagaaaccgagtcactgtgaaaagatgggaaattatctcctgcgaaaactcaggtgagtcttga

SEQ ID NO: 961 - DNA, 4130 bp, Homo sapiens
acaagagacaatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgagaggaaaggccagatgaggacacagcaagcaggcagatggctgcgagctggaagggaagcgtcatcagaaaccaaccctgagggtaccttgatcttggacttccagtctccagaactgcccctggcagctcgtggttggcaagagcacgaacccgtggtcagatgcaacgtcctgcctcatgcattttcctcttggtgctttggtcagaacttccccaagtggagtgaaactcaggagctgagaaaccgagtcactgtgaaaagatgggaaattatctcctgcgaaaactcaggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatg

SEQ ID NO: 962 - DNA, 522 bp, Homo sapiens
aatgacaaatatgagcctgaaggaagatgagctgatggcattcccagcttattaccactccttgggggccttatcttacatacatggattcaattcgtagattcagctgggatttactgcctcaagatggttatgttggaggattccaatagttctactggatgtggagccagaaattgtgtggaatgcctggtgtttctttcagttcttggatgccaatctgagaacttccccaagtggagtgaaactcaggagctgagaaaccgagtcactgtgaaaagatgggaaattatctcctgcgaaaactcagttgcctgggagagaatcaaaagaagcccaagaaaggaaacccagatgaggaaagaaaacggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcct

SEQ ID NO: 963 - DNA, 2555 bp, Homo sapiens
gtggagtgaaactcaggagctgagaaaccgagtcactgtgaaaagatgggaaattatctcctgcgaaaactcaggcaggaaatgactacatttgaaagaaaacttcaagatcaagataagaaaagccaagaagtttcatccacttctaatcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctc

SEQ ID NO: 964 - DNA, 3764 bp, Homo sapiens
atccaagatagatcaactctccctaaaggctgacagtgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaagacaccccaatccatttacagaaaagaatacatccccttcccagaccacagaccagaccagatctccaggtggtatgggaagaggaaagttgaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctttcccacacttctgagagctgccaccccaggagcagctcagatagaatcagctggagaccacagcatcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacactattgcagggctatgtacgtgcacaagacagattcagactgtcagagaaaacaggaagggcccttaagttctaccctgttgtttcacaagaggggaaactgaggcccggagaggtaatgtgacttgctgaagagtctactcccatggaggaaatgaatctgatgatgaaacccatcatgaaaactccacagaatgactgaatgtggttcccaggagggcagtgctgcagagctggcaatggggaaggaccccagcttgtctgtcattgccaaggcagaggaaggcgtgctctggccccacggggctcagaagaaggggaaaacacatggcatttcctttgtctctgagctcgcaaatctttgtgtttttttttttgtttttttttttttgagacggagtgtcgctctcttgcccaggctggagtgccgtggcacgatctcagctcactgcaacctctgcctccagggttcaagcgattcttttgcctcagcctcctgagtagctgggactacaggtgcgcaccactacgcctggctaatttttgtatttttagtagagacagggtttcacaatgttggccaggctggtctcgaactcctgacctcgtgatccgcctgcctcggcctcccaaagtgctgggattagcaggcgtgagccaccgcacctggctgagctctcaaatctttatgagcctgggcagaggggagaacctctggtgagtgatttgggagagagggtggatctcctagcagaagaactcaggcatggtcctcgcccaggacaggggtccacaagtgtgcatgctcagtgctcgcacagagctgcctctttgaagaaattccagcagacacctttggccctttgcatgcttggctcatgggcacaggtgtgttttgtcagtgattttgtactgcacaccaataatatgactcccagtatgggagcctgagtctctgccattgttttcacaggatacctgctggcctcaggccacctaccttagggtcactttggcacctactaagctccttccttagtcatccaagtgtccatgtaaggacactgtcttccatcccaactgaaagtcagagcctgacacaggctaagtcctctatgtttgttggatgagtgaatgacaggagttgaacaaatgagttgaatgaatgaatgacaggaggaggagccagggggtgcagaaaggttgcacctaccttagggtcactttggcacctactaagttccttccttagtcatccaagtgtccatgtaaggatgctgtcttccatcccaactgaaagtcagagcctgacacaggctaagtcctctatgtttgttggatgagtgaatgacaggagttgaacaaatgagttgaatgaatgaatgacaggaggaggagccgggggtgcagaaaggttgcacctaccttagggtcactttggcacctactaagttccttccttagtcatccaagtgtccatgtaaggatgctgtcttccatcccaactgaaagtcagagcctgacacaggctaagtcctctatgtttgttggatgagtggatgacaggagttgaacaaatgagttgaatgaatgaatgacaggaggaggagccagggggtgcagaaaggttgctgcaggagacagctgtgggatggagtggagctggctgtcctcacacctccaacatccagcctttctattgagcatccattgagccatgtctgggccaggccctgacctcacagagcctcagtccagcagtcagggaggagcatgaggtaaatggctgcaggacagagaggtgctgcagctggaggccctgggggacagcgatggattgcgaggagtgagggagacccaggatatgctaagcaggggcgtctaatcttttggcttccctgggctacattggaagaagaattgtcttgggccacacataaaaaaaatgaacaggggctgggcgcagtggctcatgcctgtaattccagcactttgggaggcctatatgggcggatcacctgaggtcaggagtttgtgactagcctgtctagcacagtgaaacactgtctctattaaaaatacaaaaatgagctggcatagtggttcatgcctggaatcccagctactccagaggctgaggcagcagaatcgcttgaacccaggaggcggaggtttcagtgagaccagatggtaccactgcactccagccttggtgacagagtgagactccatcccaaaaacaacaacaacaacaacaaacttacactaacggtagctgatgagctaaaaaaaaaatcgcgtaaaaaaaccccataatgttttaagtaagtttacaaatttatgttgggccacattcagcctgcaggcggagggttggacaagcttgtgcgaaagtaaaggatgtcatgagagcaacgggcaggggttgacggatgatgaatgaagacctggcctgcctaggtagggccagggagaatcaggtaggtcaaggccagaaagctgagggagattacccagctgaagggacaggttgggagggaagagagggtggcttgggccatgggggcagcacgtttgaagtctctgacttgggaagaagctgagcaaattccttaaaagtccagaaagaccatgcattggtctcctattgctgctggaacaaaataccacaaactcagtgccctaaagcaacacatgtttatttgacagttcttattataaatgtgaataaatgcacatttattcagaa

SEQ ID NO: 965 - DNA, 695 bp, Homo sapiens
cttaacatgtttttgactgcagtaaatccacagccactctctactccgagctggcagattgagaccaagtattcaacgaaagtgctcactggaaattggatggaagagaggagaaaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctttcccacacttctgagagctgccaccccaggagcagctcagatagaatcagctggagaccacagcatcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacacta

SEQ ID NO: 966 - DNA, 4560 bp, Homo sapiens
atgacccggatgtcctgcccctggggttcctaccagtgggagccgggggcatgtcctgcagccccaagaggcataggtggtggggacatggctgggggtatcccagatgtgcgggggctccaggaggcagctctaggtgcgggaaggagccaagaggaggcacgcctggtggaggaagcccagaccccagtgatgctgccacaggattcggggcagagggtggaggaggttcccggggacctgatggccaagagaatgtcgctcatcttgcacgtgcaaaagttgccctgggaccacgtgccttgcctgcggaggacccggcaaaacctgtaccaggacgtcggtggccacgcccacggctcagggctgggcggggccaagcgcggggcagcacgctctgctctccgacgtcccctcccgcccgcgacctgccgacctgcggggatcgttagcggtcccagcccccgtctagattcaaatccgactggggcccatctgattaaacagaccaggccactcactgtggagtggaccaaggatactcctgtccctgagcccatggagctaaggtctgatgccagccacaaggagaatgtgtccccaaagcctgcagcgctcccgaagccaggcaagaggcttaagcaacgaagattccggaggagcctgggcatcggcctgagtggtagacatgaccagtgggtgcccgggtgccaggtggagaggggagggcctgctgccacaccctccccaggggcagtgctagaccaggagccctgccgagtccagaccaacctggccagccctggtccccgcctgggcctagctctgaaggacacgactggccaactggtcaattcaagcttctggcaacagagcaacctgcagtccctggccaggaggcgccaagggaaggcccgagagtttgccatccagcagagcaacctgagcatcaacgagaccagcagcccccacctctgcccagagcctgggggaagctctgggccccacaagcttccctggggtcctctcctatcccaagagccactggctcgcccatcttcctgcctgaggcagtccgggctgccggccccaggcacccctagcggggacttcaggcccactgaagcctttgcccctctcgatgggcatacacagccaggcctcagatcctggggtggtctggggagctggaggtccaggctggtgggggaacctctcaccctggaggacctggctgtccccagtcagaaccagactcaggccccatcccgtgctgccgtccaccagctgctggcttctgtacattgcctggcgcaggaggcagcccgactcaggtgccaggctccccaggaaccccccgcctggggagtctcacccaagcagaaaggagaggagggggccccgagggagcgggtccacagggaggaggagaggacagctttccatctgtcagacacagtcccagcgagcagtgcgtcgaagaacaaggcacaaaacatcacagccccagagtctgaggcaatctgctggcagctgttgtccagatgttttcgatcctggaggcacttggtgaagaggcagcgggagccagcggcggcggcagtggcactgggccgctggcagctgttgcgaaagtgccttcaggccttgtggctccgggaggctcagctggaggcagcatgggggcagtacacaaaggttctgctggtccggagcttccgagaggtcagcggtctccaggttgggccagggggccgtgtgaagcagtgtccaggaagtctgagggaggaggagattgctcagcggcttctgtcacatcctaggcagagaacagacagcagacacgagagagtccagatcctgcaggccctgcaactggctgtgttcttcctgtggtgccaacagaagaaacgggccagacaggagagggagactctgcggaaggccaccagggccacacagaggacagggagcttcccccaggcctggcactctactgctgcaggtgtagcctgggtggccccactgagcccccagcaccagagagcttggctgtgcaggtgcttcggggcgtggcagcagttcgtgcaaagagggtcccggtaccgagaccacctggctgaccgccggacggggaccctgaggaaatgcctggaacagtgggtgcggatgaagcagctccgggaatcagatggggcaaaggtgacccagctgtccctctgccggcagaaagcaggacgtgaggctgtctacaccgcaggccctggagcctgtggcctgggtgcagtgggccaggcccaggggcagcaggagcaaggccggggctccctgcaggatgcctgctggacactggccctctgctgggcgctgctgctgtggaagatgcggcttttccagcgccagtgggccaactccttcttccagggcctgcagcagcggatgctgcagcgcagcctgagatggtggcacttgagggcactgggcccagatgccacatcaagctgcaccaagaccccctcggctctggagccactgagcagcagcacactccaagactctctggagaaggttcccagggcccccaccctcccggacactctccaggggagccttctgtgggcagctgggcagcggcagcaggggcagtgccttctgctctggcaggcacgggcccagcagttccagggcacagccaggtggtaccagcatacccgccagaggcgcatcttcctcagctggagccgctgggcaacagcccaatgggcctggagagagctggcttcccaccgggcctgggatcggacctgcagggctgtgctgggcctgtggcgtcagcggctgctgcagtcacggctggtggagtggtgggcccaggagcggggctggcggctggcacgagatgccctatgccactggcactcctgttggcaggggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagagctacttccaggcctggtgtgaggttgtaagagacacgggggtgctccgggcccagcatcaagcctttcaggatggcctgaggagaagagcactgggggccgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctgggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaagacccgcagctgctggacacaggccacagagctggtgcctcccgcgccatcactgcagtgcagcctgggtggacggaggaagccaaggggaacggcctgggctcagaggtgcagggaacattccctctgccctgccttccagctctggccacagtggcctggacagagtagctgggtcccaggcctgcccctgtggacgagggaccagggaccaagagcgcactccagccctgagcccagagcctgcaaagcccaaagcaaggcccataaacggaggctacgtgctcgttcctgcaggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctgctcagggagtggcacctgagatgggcctggcagacgtggtggcagcggatcctgcgactgcgagtggctcagcagttacagcagcaggaagatgggcctttaagaagtggcaccaacgcctggcagccaggagcccaaggagaggagctgccagtagcccaagaccctggagcaagccaggccccaagggccccgagagtggacaggaagccgccagagcaccgcggggttgggggcttggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtcct

SEQ ID NO: 967 - DNA, 734 bp, Homo sapiens
agctaaggtctgatgccagccacaaggagaatgtgtccccaaagcctgcagcgctcccgaagccagagcaacgaagattccggaggagcctgggcatcggcctgagtggtagacatgaccagtgggtgcccgggtgccaggtggagaggggagggcctgctgccacaccctccccaggggcagtgctagaccaggagccctgccgagtccagaccaacctggccagccctggtccccgcctgggcctagctctgaaggacacgactggccaactggtcaattcaagcttctggcaacagagcaacctgcagtccctggccaggaggcgccaagggaaggcccgagagtttgccatccagcagagcaacctgagcatcaacgagaccagcagcccccacctctgcccagagcctgggggaagctctgggccccacaagcttccctggggtcctctcctatcccaagagccactggctcgcccatcttcctgcctgaggcagtccgggctgccggccccaggcacccctagcggggacttcaggcccactgaagcctttgcccctctcgatgggcatacacagccaggcctcagatcctggggtggtctggggagctggaggtccaggctggtgggggaacctctcaccctggaggacctggctgtccccagtcagaaccagactcaggccccatcccgtgctgccgtccaccagctgctggcttctactcttggg

SEQ ID NO: 968 - DNA, 3135 bp, Homo sapiens
agaggaaagcggattgttggccccaggacccagctctgagaggctgggcttgtttccctgactctgccttggaggaaagcaatggaaggggaaggggtaagaaacttcaaggaacttcgagccaaatttcaaaatcttgatgctccacctcttccaggacctattaaattcccagcaggtgtttctccaaagggtgacattggaggcacacagtcaactcaaattttggccaatgggaaacccctctcatccaaccacaagcagcgcacaccatactgttccagtagtgagtcccagcctcttcaacctcagaaaataaagttggctcagaagagtgaaattccaaaatgttctaactccccagggcctctgggaaagtctactgtatgttctgcaacaagttcacagaaggcttctctgctgttagaggtgactcaatcaaatgttgagataatcactaaggaaaaagtaatggtggccaatagcttcagaaacaaactctggaactgggagaaggtttcatctcagaaaagtgaaatgtcttcagcccttctccttgccaactatggaagtaaggccatccatctggaagggcaaaaaggcatggggcttactccagaggaacccaggaaaaagctggaaacaaaaggagcccagactcttccttcccagaagcacgtggtggcccccaaaatattacataacgtctctgaagatccctcttttgtaatttctcaacatatcagaaaaagctgggaaaacccacctcctgagaggagcccggcaagcagcccctgccagcccatctatgagtgtgagcttgccagtcaggccccagaaaaacagccagatgtcaggcatcaccaccttcccaaaacaaagccattgccctccatcgactccctgggtcctcctcccccaaagccttcaagacctcccatcgtgaacctccaggcctttcagaggcagccagctgctgttcccaagactcagggggaagtgactgtggaagagggctccctgtctccagagaggcttttcaatgcagaatttgaagaaccacataattacgaggcaacaatttcatatctgagacactctggcaactccattaacctgtgcactgcaaaagaaattgctgatccaacttatgaagttggaattgaagaactccaaaagcctgggaagaattttccctatccagaacctagtgctaaacatgaagataaaaaaatgaaggaaaaacaaccatgtgaattgaaacctaaaaacacagaaaaggaaccatattcaaaccatgttttcaaggtagatgcctgtgaagggacacctgaaaaaattcagatgaccaacgtccacacaggtagaaggaacatgttggctggaaagcaagaggccatgattgacatcatccagacaaatccctgccctgagggcccaaagctggccaggcactcccaaggccactgtgggcatctggaggttttggagtcaactaaagaaactccagacctaggggtctctaagacaagttccatctcggaggagatatatgatgatgtcgagtactccaggaaagaggtaccgaagctgaactactctagctcacttgcctcaagtagtgaagaaaatagagaactgtatgaagatgtctacaaaacaaagaacaactacccaaagatagatttagatggaaaagaagcactcaaaagactgcagcaattcttcaagaaagaaaaggatagatttaaaataaagaaaaccaagtcgaaagaaaacttaagtgcattttccattttgctgcctgatttagaacttaagtctcaggaagttattatttatgatgatgtagacctgagtgaaaaagagtcaaaagatgaagataaactgaaaatgtggaagcccaagtttctgacaccaaaggaaaaaaaagagaaaaacggtgctgaagaatcagaaagtttctctcctagaaatttcttcaaaaccaagaagcaaaacttagaaaagaacagaatgaaaagagaagaaaaactatttagagaaaggtttaagtacgacaaagagattattgtcatcaatacagcagtggcctgttccaataattcaagaaatggaatatttgatttgccaataagtcctggagaagaattggaagtcattgataccaccgaacaaaatctagtgatatgtcgtaattctaaaggcaaatatggatatgtgctcattgaacatctagatttcaagcatcaaagttggtcaccttagaaaaatcaagatcaaatgctatggactgcacaaaggagaactagtcctaagatcctagtcctgcgttacatcagtttcagtttacatgtcaaaattttgagatggtggaatctgtggaaactttcgttctgaacttaaaagagaaaaataaaaacaaatcctcaacatttagatgttggttttactcctaaaaggttatctttcaatgtctatttcagtatctacttcactgtcagttcaagagaatgtgaaacagtatgtgttagcatttgagcacttatttaatgagccatatccaaagttagaaatcatgccttatggcacctagtcagttgtgcagatggttagtttgcttctaatattagtatatgagcatttgtaatttctagatgttgtgcactcaaacttggtataatttaattctgaacagtaaacagtgtaaccaaggtcttttaaatactcaagtttaaggtataatcttaattatggctcagtctttaaaaaagtataaatgtccttttactttatcacaaaaataaactcatatgaatactgttccacatttgtttcttttgggaatagtttgcagaaaaataatttattcctaaattcacccatcattttaagaagtgcccaaatgtatttaacaaaataatatatatgctgtattactttaaaacatctttttgtccaaaataagaacaattgtcattattttgtctatgcccaaataactattcaaataatagcattcatatgtactttcatttatatggaattaaataaaaatttaaaagctgacatctattctgttttttaaatgaggtgcactgcatgtcaataagagaaataaattctacatatgca

SEQ ID NO: 969 - DNA, 3064 bp, Homo sapiens
atgccgacccaggacgggcagctcagacgcccagctcggccgccgggacccagggcatggatggagccccgaggcggtgggagctcccagttctcatcctgccctggtccggcgtcttctggagaccagatgcagaggcttctgcagggccctgccccacggccccctggtgagccccctgggagtcccaagtcccctggccacagcactggctcccagaggccccccgatagccctggagccccaccacggagccccagccgaaagaagaggcgagctgtgggtgccaaggggggtgggcacacaggagcctctgcttctgcccagacgggctccccgctgctccctgcggccagtcctgagacggcaaagctgatggccaaagccgggcaggaggagttggggccaggtcctgcaggagctcctgagcctggccccaggtcccctgtgcaggaagacagaccagggccaggtttgggcctgtctacacctgtccctgtgacagagcaaggcacagaccaaatcagaaccccgcgccgagccaagctgcacacagtgtccacgactgtctgggaagccctcccagatgtctcaagggctaagtcagacatggctgtgtctacacctgcctccgagccgcaacctgacagggacatggctgtgtctacacctgcctccgagccgcaatctgacagggacatggctgtgtctacacctgcctctgagccgcaacctgacacggacatggctgtgtctacacctgcctctgagccgcaacctgacagggacatggctgtgtctatacctgcctccaagccgcaatctgacacggctgtgtctacaccagcttctgagcctcagtccagtgtggctctgtctacacccatctccaagccacaattggacacggacgtggctgtgtccacacctgcctccaaacatggcctggatgtggccttgcctacagcaggcccagtggctaagctagaggtggcttcatctccacctgtctcggaggctgtgccgaggatgaccgagtccagcgggcttgtgtctacacctgttcccagagccgacgccgctggcctcgcctggcctcccacccgcagagctgggcctgatgtggtggagatggaggcggttgtgtctgagccctcagcaggggcccccggatgctgctctggggcacccgcactgggtctcacccaagtccccaggaagaagaaagtgcgcttctccgtggctgggcccagccccaataagccaggctcaggacaggcctcagcccggccctcagccccccagacagcaactggggcccacggggggcccggagcctgggaggctgtggctgtcgggccccggccccaccagcctcggatcctcaagcacctgcctcgcccccctccctctgccgtgacgagggtcgggcccgggagcagctttgccgtgaccctcccggaggcctacgagttcttcttctgtgacaccatcgaggagaacgaagaggctgaggcggcagcggccggtcaggatccggcaggcgtccagtggccggacatgtgcgagttcttcttcccagacgttggagcccagaggtcgaggcggcgggggtccccggagccgctcccgagagctgatcctgtgccggcccccatacctggagaccccgtgcccatctccatccctgaggtctatgaacacttcttcttcggggaggacaggcttgagggcgtgctggggccggctgtcccgctcccactgcaggccctggagcctccccggtcggcctccgagggggcggggcctgggacccccctcaagccagccgtggtagagcggctccacctggctcttagacgggcaggggagctccgggggcctgtcccatcatttgccttcagccagaatgacatgtgcctggtgtttgtagcttttgccacctgggctgtgaggacgtcagatccgcataccccagacgcctggaaaacagccttgctggccaacgtcggcaccatctctgccatccgctacttccgccggcaggtggggcaagggcgccgcagccacagccccagccccagctcctaggagccaggcccgggccagggagatgcaggatgaggagacgaccacaggcgcccagggcaggacgaggtgccgccctcgcccgggccctctgacccctctcttctaccgcgtccaggaggggggcgtgtcctggtgctgctccctccgactcacctgaggatccagccagtgaccacggccactccccacgcctgggagggaggtgctaaagtctgggtgggtggagggcaggcaggtggctgggtaggagggtggccagattcacagatgagaacacagggcattcggttaatttcagacaggcaatagtggggaggtcattttactaagaagttgttgtttatctgaaatcaaatgcaaccgcaccctgcgtttcttctggggtgcagggggagctgagtggcaggacaggacttggacctcggaggggtctgagcagcaagacactccggctggagctctgggcagaggcaggggagaggacacagggtggcctcaaagaggggatgggcagcctcctcacaggtgggctgggctggcaagggctccaaggcccatcactcttgatcctcaaaggactgtggccaaggcctctgcgggctctggcctgagacagcgaaggctctgcctgcccctccccagtgcagcagcccctgcagggtgggggtctgtggcagagccgcgagcccctccccgggagccctgggtgcaggtgcagagggagaattcggtggcctcagatggagggctgggctcctggggttgtcccgggggctcctgtggggcagctggggacccacagccaagaggagtcagagatgaggtgggaaggtcggtgaggggcccgaggtggcagaggaagggggctgcctggctgggtgctgggtgggggtcctcaagactgtgggagaccctggctgctgagcagagaacacatggatgcagcaccaataaaattctatcttttcttttt

SEQ ID NO: 970 - DNA, 1793 bp, Homo sapiens
gagcggcgagggggcgggggaggggctgagccggaggcggctcacctggcgggacaggtgcctggctgctacaaaccatgcaatgagccatgccccgccctggacacccccgcccagcatctgggcctccacgcttgggaccgtgggagcggccaacagagctatgtctggagacatatgataaaccacctcagcccccaccaagccgccgcacccgtagaccagaccccaaggaccctggccaccatgggccagagagcattaccttcatctctggctctgctgagccggcccttgagtcccccacctgctgcctgctctggcgaccctgggtgtgggagtggtgccgggctgccttctgcttccgccgctgccgggattgcctccagcgctgtggagcctgtgtgcggggatgcagcccctgcctgtctactgaggactccactgaggggactgctgaagccaactgggccaaggagcacaatggagtgccccccagccctgatcgtgcaccccccagccggcgggatggccagcggctcaagtcaaccatgggcagcagcttcagctaccccgatgttaagctcaaaggcatccctgtgtatccctacccgagggccacctccccagcccctgatgcggactcctgctgcaaggagccactggccgatcccccacccatgcgacacagcctgcccagcacctttgccagtagtcctcgtggctccgaggagtactattctttccatgagtcggacctggacctgccggagatgggcagtggctccatgtcgagccgagaaattgatgtgctcatcttcaagaagctgacagagctgttcagcgtacaccagatcgatgagctggccaagtgcacatcagacactgtgttcctggagaagaccagtaagatctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatgagctgacagtgcagatctcccaggagacgactgcagatgccatcgcccggaagctgaggccttatggagctccagggtacccagcaagccatgactcatccttccagggcaccgacacagactcgtcgggggcacccttgctccaggtgtactgctaacccctgccaggcccagctgccacaccctttctgggagaagcatggcctacagaatgaagagggggaccaggaacccctgtgggagaggcttagacctgaagcagtgcccactctggctcctcctgccttggctgactgggttcctggaccatgtgcatttcactgggccatgggatctacatctccttgcatccccagctggtctgatccctgccagggccccttccttcctgctcatggtcttcaggtggcctgatcatggaaagtaaggagttaggcattaccttctgggagtgaaccctgactccatccccctattgccaccctaaccaatcatgcaaacttctccctccctggggtaattcaacagttaaaagaagcttatcttaaatgtattgtattggggggtgggcagggcccactctatgttatgttaaggagttggttctggttcttggctgatgttctgtatcttaacatgaccacagtttgtaagtacaaaggtaa

SEQ ID NO: 971 - DNA, 1651 bp, Homo sapiens
ggggctgagccggaggcggctcacctggcgggacaggtgcctggctgctacaaaccatgcaatgagccatgccccgccctggacacccccgcccagcatctgggcctccacgcttgggaccgtgggagcggccaacagagctatgtctggagacatatgataaaccacctcagcccccaccaagccgccgcacccgtagaccagaccccaaggaccctggccaccatgggccagagagcattaccttcatctctggctctgctgagccggcccttgagtcccccacctgtctactgaggactccactgaggggactgctgaagccaactgggccaaggagcacaatggagtgccccccagccctgatcgtgcaccccccagccggcgggatggccagcggctcaagtcaaccatgggcagcagcttcagctaccccgatgttaagctcaaaggcatccctgtgtatccctacccgagggccacctccccagcccctgatgcggactcctgctgcaaggagccactggccgatcccccacccatgcgacacagcctgcccagcacctttgccagtagtcctcgtggctccgaggagtactattctttccatgagtcggacctggacctgccggagatgggcagtggctccatgtcgagccgagaaattgatgtgctcatcttcaagaagctgacagagctgttcagcgtacaccagatcgatgagctggccaagtgcacatcagacactgtgttcctggagaagaccagtaagatctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatgagctgacagtgcagatctcccaggagacgactgcagatgccatcgcccggaagctgaggccttatggagctccagggtacccagcaagccatgactcatccttccagggcaccgacacagactcgtcgggggcacccttgctccaggtgtactgctaacccctgccaggcccagctgccacaccctttctgggagaagcatggcctacagaatgaagagggggaccaggaacccctgtgggagaggcttagacctgaagcagtgcccactctggctcctcctgccttggctgactgggttcctggaccatgtgcatttcactgggccatgggatctacatctccttgcatccccagctggtctgatccctgccagggccccttccttcctgctcatggtcttcaggtggcctgatcatggaaagtaaggagttaggcattaccttctgggagtgaaccctgactccatccccctattgccaccctaaccaatcatgcaaacttctccctccctggggtaattcaacagttaaaagaagcttatcttaaatgtattgtattggggggtgggcagggcccactctatgttatgttaaggagttggttctggttcttggctgatgttctgtatcttaacatgaccacagtttgtaagtacaaagg

SEQ ID NO: 972 - DNA, 7159 bp, Homo sapiens
aacagggaagctgtggataccaacggagggtgggagcccgggaggctgcgggtagcccgggcgcccaggggcggcggcggcccagcccaggtgcccgcgcacaggggacctcggtgcggagccacccctcgagcgcgactgtcgcagcgccagcgcgcacggggccccacgcacccaccctccgcacctgccgcggggtccaaaagggatcctgcaaaaatgagccattctcaccccgctgggttacttgctgcatataatagccttatggataaacacctggctgggtattttaacaatacaaggataaggcgtcatctcttaagatcaggactgatcacaagaagtggaagaatactttctgaaaaagaatataaactaaatatgatgaagcgggatcatcaaaaatatatccgggaatgcttagcccaggcaatttttcataaagttcttgatatggagcgttaccatcagcttgaaataaaaaagaaattggagaccttagctaggaaggagcgaatccagaggtttaagggagagcacacaagaaggtctgttgaaaataacatgccaatcctgtctccccacccaccagttggcccaaagagtaatcgtggccatagtgttctggttgatgaaggacattccagtccgttagcactgacagcccctcgaccatatactgctccaggaaatatgcagcctccaattcgattacagcctcttcccagtaatcctgcagtagaaactgttccaaaggtaacttcaaggtccagatcaaaaacctcattgctggaaaatgaagctctgtttcccattgggggcaagaaggcagtgatgaagttcaggaactccataggcaattcacagagaatgaattcatatcaacttccaaacattaacagttacatgatgcctattcctcctccacttcccccaactgggaaaatcacaagagaaaatagatctgaaacatggagaaggagaagatttcgtccaaccactgctccaaatggcttagaacctcttttgacaaaggattcaagaaggattcataaaacatccttacatagtaatgcagctattacaatgatctatttggggaaaaatgtgcacctatcttctgataatcctgacttccgggatgaaattaaagtttatcagcagcactgtggtggggaaaacctttgtgtctacaaaggcaaactacttgaaaaagagacctttcagtttatttccaaaaggcatcatggtttccccttcagtctcacctttttcctgaatgggatgcaggtgaacaggttaagctcctgttgtgaatacaagcatcggaaaggttccaggcttggaggcaaacgaggctactttgggtttgtgtgtgttgagagatcatctccttgctacaagtgcattattgcaatgggccttgacaaaaaaccgtctttgccgaaatctaggaaagaaaagagcactgagaaaggagaggaactgaagaaggctgaggggaaagtgaggaaagagagagagtatgtgataccaaaaagaaatgagatcaaggagaacaaaacctctgtttcagccaaattttcagctcaagaaataaaaacagggctcaaagaagtggtaactgctgtggaggaaatgacaagtaaaggaaaaccaggacaagaagtcttggaagacgaccaggaaaatactttaaaatatgagtatgaagaagactttgaagtagatgaggagaaacaaggtgaaaaatctaatgaagaaggacaggctgatgttcaaatgaatggaataccgcagtcacctttggatgataaaaaagataatttagaccctgaaaaagagagtgaaacctcatcacagaaggcaccagatgcccgtgacaatgtgaaagatgagaatgatggatgctctgagagtgaactggaagaggataaacaagatatgaaaactgcttcatcaacctcatccagaagtcacccttattctagtgacagtgaggatgaatctgcagtgggggacagggaagcccacactgacagcagcacagatgaaagtgccagaaggtcatcttctcaggaactgagtgaaaatgataagccaagaaagtctcaccttccaattgaggaatccttagaaattgaaattgaagaccaagaaataacaaaagcagatgtggagaccaagccgatgccaatagacgaaagctttgagaatgttcttaaagaaggaacggagaaaggaacccaagagattgcagagggtttatctgagaagtccgggaaacatgtttctgcagaagaaaaggaaaaggataagagtaagctttgggaagaaagcactgctcaggtgaaggacaaaaaggcaggtctccctgggttggaggaaggtggaaaggattcattgccattagcctatgtcctggctcttggtgcaccaacaatgaatttcatggtggatgaaacagcagcaatcaactcaaacaaggaatcccagcaattggtgcaaaaaacgtatacactggagaagaaagaagcaatggaggaagatgaagcgccccagcacagagatgctgacatagtacagggaaaaggggaggcagcactgtggggagaagcaggagctgttcatgaggctcccttgagggcgtggaagccaacagcagagcagccagaattggcagaagagtttacagaaaaaagggagatccctccaggcatagaaaggggggcagagggagcagcagaagcagaaggggtcagaaggctgggtgaaggggggtcagaccccataggacaagcagcagcaaaagatgctgtgggtctgagtaaagatgaggctcctgaaaagcaagccttgatgctcacagtgcttgagacagacaaagcagcttctgaaggggaacagggtttagagaaggcagtgcttgcaaatgaagcagcagccctgaacttggagcatcttcatgaagtagcagccctgagagaggcagcgacatcggaggagggagaggctgagggtggggtggctgtgagtgatgtcggagaaagtgaagaggaagcatccatagacctagaggacacaggacccatggaggacacagcatcaaagagagaggacggttctgaagaggcaattcttgggggagaggaaccagccaaagagagaaaagaggttatgagaacagaaacacgcttgagccccttcacaggagaggcagaggcaagccggatgcaggtttcggagggcagccctgaggaaggaagccttgcaaaggaagccttcctttgcaaggaagatgtggaaggggaagagatggtgactgaggcagaagctaatagggaagatgataggaaagaaattttacccaaggaattagatttagcaagagagcgaaggaaagctgagaggccaaaaacatctctgaggaaaactgactctgagagagaagaggtgacaagggcaaatgcactcaaggatgaagatgcttttaaagaagagcaaaaacttaaagcggaagaaggggaaacagagacagaagtaagagctgaggaagagacaaaagctcccccaaatgaaatgggatctgatgctgagaacgaagcacctgtggaggcttctgagttgtctgacaatccagggcttctaggagaagattcactaaaagagacagtggttcccatatttgaagcaacgcctggatttgaaaagtcgctggaaaacataacagctctgaggaaagaaggaggaggggaaagactgagtgaagccagagacacagagcacaaagacagagaagagctgtccagcagggagaatagggccctgaaggaagggcaccgccaagatggagagggggccttagcagctcctgaagctgagccagcaggaaaggtgcaggcccctgaggggctgatcccagccacaggccaggcagaggagctagcagccaaagatcacgactcctgcgcaggactggaggggagagctgaagggcaaggaggagtggatgtcgtgctaaggacccaggaagctgttgctgaggaagatcccataatggcagaaaagttcagggaggaagcggtggatgaggacccagaggaggaagaggacaaagagtgcactctggagacagaagcgatgcaggacaggaactcggaaggggacggggacatggaaggagaaggaaacacacaaaagaatgagggcatgggaggaggaagggttgtggctgtggaagttctacacggaggtggtgaaacggcagaaacagccgcagaggagagggaggtgttggcaggttcggagacagccgaggagaaaacaatagcaaataaagcctcctccttttcagatgttgctgaggaagaaacctggcaccaacaggatgagttagtaggaaaaacagcagctgcagggaaggtggtggtagaggaattagcacggagtggggaggaagtgccagcagcagaggagatgacagtgacatatacaacagaggctggggtgggcactccaggagccctggagcggaagacctcagggctaggacaggagcaagaggaagggtcagagggccaggaggcagccactgggagtggcgatgggaggcaggagacaggagcagctgaaaaattccgattaggattatcacgggagggagagagggaattgagtccggagagtctacaggcgatggcaacacttccagtgaagcctgatttcactgaaacccgagagaagcaacagcatatggtgcaaggagaaagcgagactgcagatgtttcccccaacaacgtgcaggtctaggagacttgctggcagacagataatttaaagatgtcttctgaagatgtaaagagtggagaaagattcacgcaagcatctcaccaggattcttgattttctctctctcctctttagttgctggttgcgcttgtctgagatgattcccaatctgtcagccctggtcagtagctcagtaagcaccttgagaatagctcaagtagatctgtaggacccttcttagaagcagtggttcctcatggagaaacttgtgaggctgttacacattctacacacctaacattattttcaaacaaaaatgataattttcagatgcttgacttttaccaaagatcactggaaggcccagtcctaatgttaggggtttgtttaaagtcctttttattttacaatacagagccccagtcaattccacaatctcaatttcatacatgggaattttatttaaaaatctgtggtttggggctttaatgaattggcctgtgaaaatgagctctaaatttcctcccacgtacactcaaaactcaagattgctccaaatctctaagttcttccagcaaaagatttcttggcatgtatattcacttatacttagaaatattcattcttttaatttatgccagaataacaaagtggaaatcttatttcaaaatgctctttgtttttttgtgtgtgtttctgtagttctgctttctggggtagactagtaaaatggtagcttccagcattttgtccctggggccttctttatagggccactcaaatttaaataaaagtagtaaataatttagctaagtggaataagtataataattatagtggtaagcatagcacatcagcattatgccaacattctagactctttagttgatgtcattaaatggaaaagaaacttggattaaatgagtgtgctgctcaccttcccaagttctgttatttcaaacctgtgaactaaccttgcagttcattataaatcaacagtaacaactgcattctaaattactccctgatattattttctagttgtgtatcagcctgtctcctaggggttttcatttccctgaagacatacaagtgccccagagcgcatgtatatgtctaccatttctctatatgagaaggtaaaaaaaatttccttaagcagtgattttccagccagaatatacattagattttcatgggacgcttttataaatgactcaacccttttccccaccccagagattcagacttaattcgttttagatggatctacacatcagtatatatatatttttaacttttcacttgattcttctctgtagccaaggttgagaaccgctgttctaaatcatcatataatccatgctggccacattacactcaaggtccctagggaccaggcatattatcatagtaggtattttccattttaatgtgtaatggagccattcaatgatcaaaaatacactggaccagatagtagactggtcccttgatcagaagcatcagcacatcagcatcacctggaaattgttcccagcctttgtctcctacctactaaattagaaactcttggtgggttccagtaatccatagcttaacaagccctgcagttaatactgatgtacactgatgtccaaaaactgctgtcatggactattgattgtattgaggattagtctcagttggaaagccaactacagaggcattttgaactttctttctttgcctctctatgtctctctgtcttttcctgtcttctgatttatctgtctttctttctctagtaaatggcactcaatataaaagtggtggagtcaatcttaaacttatttttattatgattgtattgatacatgcacgaagtccctctgccctactccctattcaaggatattactcactgcacatcataaatctccatcatctgtcttaaagttttatgagtagatttcatctacattatattcaagttcatttattactgagctgtattactgtggagctctaacagtatttgtttcctgatttcaaactcaatgctacagagcactttgaatacatcacaccttataggaaagatagtaaatgtattaatcccattgaaaaattagttttgtacaatgtgctaaatagtattgcattggattacttttatatttaacacactccatcaaaacatcccataacataattttacaatctgcatgtgaatttaactgtgaaattcagtattgtgatattttgaataagtgaattctttctctgcaaatactatgttgataaaattacttgtatgttcccctgaaatggtttgtttcctgtttcttcattattaaaacataaatcaatcatatgtttacagata

SEQ ID NO: 973 - DNA, 2068 bp, Homo sapiens
cctgatacacccatctcatcttgggaatgggctagccaaaggtaccagaaaactcaaaggtctttggctaaaatcctctgtatcctccagcagtaactttgccattaggactagaaatactcaaagtccaatgagtaggatttcctctcccctagatagtacttggatgggtgctttccatgcttgccaagggcaagaaggcagtgatgaagttcaggaactccataggcaattcacagagaatgaattcatatcaacttccaaacattaacagttacatgatgcctattcctcctccacttcccccaactgggaaaatcacaagagaaaatagatctgaaacatggagaaggagaagatttcgtccaaccactgctccaaatggcttagaacctcttttgacaaaggattcaagaaggattcataaaacatccttacatagtaatgcagctattacaatgatctatttggggaaaaatgtgcacctatcttctgataatcctgacttccgggatgaaattaaagtttatcagcagcactgtggtggggaaaacctttgtgtctacaaaggcaaactacttgaaaaagagacctttcagtttatttccaaaaggcatcatggtttccccttcagtctcacctttttcctgaatgggatgcaggtgaacaggttaagctcctgttgtgaatacaagcatcggaaaggttccaggcttggaggcaaacgaggctactttgggtttgtgtgtgttgagagatcatctccttgctacaagtgcattattgcaatgggccttgacaaaaaaccgtctttgccgaaatctaggaaagaaaagagcactgagaaaggagaggaactgaagaaggctgaggggaaagtgaggaaagagagagagtatgtgataccaaaaagaaatgagatcaaggagaacaaaacctctgtttcagccaaattttcagctcaagaaataaaaacagggctcaaagaagtggtaactgctgtggaggaaatgacaagtaaaggaaaaccaggacaagaagtcttggaagacgaccaggaaaatactttaaaatatgagtatgaagaagactttgaagtagatgaggagaaacaaggtgaaaaatctaatgaagaaggacaggctgatgttcaaatgaatggaataccgcagtcacctttggatgataaaaaagataatttagaccctgaaaaagagagtgaaacctcatcacagaaggcaccagatgcccgtgacaatgtgaaagatgagaatgatggatgctctgagagtgaactggaagaggataaacaagatatgaaaactgcttcatcaacctcatccagaagtcacccttattctagtgacagtgaggatgaatctgcagtgggggacagggaagcccacactgacagcagcacagatgaaagtgccagaaggtcatcttctcaggaactgagtgaaaatgataagccaagaaagtctcaccttccaattgaggaatccttagaaattgaaattgaagaccaagaaataacaaaagcagatgtggagaccaagccgatgccaatagacgaaagctttgagaatgttcttaaagaaggaacggagaaaggaacccaagagattgcagagggtttatctgagaagtccgggaaacatgtttctgcagaagaaaaggaaaaggataagagtaagctttgggaagaaagcactgctcaggtgaaggacaaaaaggcaggtctccctgggttggaggaaggtggtaagtatggccgttgagttgagctgccatcatcctcatgcatggaagctgattttggtcattgcactatgccaaagcttgggaaatactactgtgacaatgctttagggattcaagattttttgctgtgtctctctttgtcacataatcatacatgtattttcagtttgctgtttgccttctcttgcacttaaaaaattactcgataatttctatccagcctgtttcctattttcggtaaattccctcctatgggaattccatctcaggaatgaaataaagcacagtatgtgtctgaaggcaa

SEQ ID NO: 974 - DNA, 1666 bp, Homo sapiens
gtcggacgccgccgcggcgcgctctgcagactccgggtcgccgctccgccgggacgcgttggccggggcgcgcggtgcttggctgcggtgctcacactcatgaggagccggaagctcacaggtgcagtgcggtcttcagcgcgcttgaaagcacgaagttgttcggcagccaggttggcctctgcccaggaagttgctggttccacgtctgccaagacagcatgtctgacttcctcatcccacaaagccacagacacgcgaacgtccaagaagttcaaatgtgacaaaggacatcttgtgaagtcagaattacagaagcttgtccctaagaatgacagcgcttctttgccaaaagtgacacctgagaccccttgtgaaaatgagtttgctgaaggcagtgccttgcttccaggcagcgaggctggcgtttctgtgcagcagggggctgcaagtcttcctctcggtggctgcagagttgtgagtgactctcgcttagcaaagactagagatggcctgtccgtgccaaaacacagtgccgggtccggagcagaagaatccaacagcagctccactgtgcagaagcagaatgagccagggctacagacagaggatgtgcagaagccaccacttcagatggacaacagcgtctttctagatgacgacagcaatcagccaatgcccgtgagccggttctttggaaacgttgagctcatgcaggacctcccacctgcgtcttcatcttgtccttcaatgagcagacgagagttcagaaaaatgcatttcagagccaaagatgatgatgatgacgacgacgatgatgcagaaatgtaggggccatacaaaataatgtccttgagtatttagtaccattaacaatttgacaatttagcacattacaagatttatataaaatgtatctccaagagaatgtcttaatcaaacttcagaactgacccatctaagtcaatagtgcaaagcacccaatacctgtggaggatgtactcatgggaactaaaactcaaaccatctttgaggttgcaaagctgctgtactgtgccaatgtcctttctttttttttttttttttttttccttggagacagagtttctctcttgtcgcccaggctggagtgcaatggcgcaatctcggctcactgcaacctccacctcctgggttcaagtgattctcctgcctcagcctcctgagtagctgggattacaggcatacaccaccacacccagctagtttttgtattattagtagacacgggggtttctccacgttggccaggctggtctcaaactcctgacctcgtgatacgcccgcctcagcctcccaaagtgctgggattacaggcgcgagccaccatgcccggccagtgtcctttcttatacacgtacatacatgatgatggcttgagtcagctgcagggcagtgggcttaatgagagggatctttgtaaagacagctcttcacttcagctcagtagctttggtcataggcaagtttgttttccattatcataatttgatgattcttgtgatgaattcaatgctagttcttaaagaactcttttatttctgtatgtggagctaatgtttaccttggaaattttgcaaaatacatgtaagaaagaaataaaatatattttgaaaatattttgaaa

SEQ ID NO: 975 - DNA, 1777 bp, Homo sapiens
acaaggcccgggttgccgtggcagcagcggaggcgggcagcgcgcaggcctgccatgagggaaagccaggatgccgccggagctcatggctggaaccgcgtcggctccacggccaccaagtggttcaccggggcgcccttcggggtgcagagccacaggtttgacatctctgctgtttatcccaactggaagaagttcagcaccttcactgaggccccatactccacgcgttattctacccaagtgtcccacataggccctgggacttacagctccaaagagacctgcttcagcaagaagaagctgatgaaggaggtggacacaggctgggccaaggcccaggaagccacgcggctgacccagctaccccacttccagtaccaggccatcatgaaagagaagcggctgaaggagcaaaagctgggccccggctcctacaacctcaaagacttcttagaacagctgcgggagaaaccatgtagcacccgggggctgctcagctctggggaggttcgcttccgaggactcactgggaactactatccaggccctggaaattatggggagaagggtaacccatacaccaagctggaggagaatgcctggaaccggtctcattccgagggcctcatgtgcaggatgagcaacaagccacacccccggccttatcaggggagtggtctgggacccggcacctacttcttcaaaagcgaccttgagacatatgtggcacgatccgtcggcacccgcggcccctatgacactttctctggtgatcggagcaagccactgccttatgggcactactccatgcagaaaaaaaagcccagggaactgatgaatttcaagagctttgtagaagaacttaactcacatcacaataagaagcatggggttttttctaaacttccccgaaacccgaaaacccctacagagaggatttactgggccaacctcagccagtgcccccgcacactggccacatctggccccagtttctggcttccacaagagaagaaatgcaaacccgtcaaccagcccccattcctgttgacctccaaggggtcaggtgcaaaggcctgccagatgattatgggaagctggaacccagtaggtgtgggccgctacctcaacacctggctgatggagacaaaggacaggcggcagcgatatcgatccctattcctgagtggatccaaacgctacctctcagacctggcccgggacatgctcatgcaaatcaggctgttttgttggaaaggcctagaagtcatcaattttggcctctcaccaatgtaggatctcctgtgaagcagaaccaacagggaaaggatcacaccatttactaagggaaagtgccctccaactgtggattacaattcagatcctactccttaaagccacatgcgaaggacagcctgcagtgaccagagagcccaaaggcctgaagacaaatctgggggtgacagcatgggcatgggagtggggtgtcttagagaaaggacacatgggcttgggagaggggagagatgtatggggatcacctttgccagagctgcatacctgaaggtcacagtgtcttccgggacagctggggacaggtatcttttgttgcaggagatcaattatcctgagaactcaactcagccagtgacatgaacatgggggccagagagcagatggactgaagggatgggacgtagttgacacttgtgggaccctttctattctaaagccagagtgcttggctccttgtttattaaagttcagaaagtgg

SEQ ID NO: 976 - DNA, 1651 bp, Homo sapiens
gcgcgcaggcctgccatgagggaaagccaggatgccgccggagctcatggctggaaccgcgtcggctccacggccaccaagtggttcaccggggcgcccttcggggtgcagagccacaggtttgacatctctgctgtttatcccaactggaagaagttcagcaccttcactgaggccccatactccacgcgttattctacccaagtgtcccacataggccctgggacttacagctccaaagagacctgcttcagcaagaagaagctgatgaaggaggtggacacaggctgggccaaggcccaggaagccacgcggctgacccagctaccccacttccagtaccaggccatcatgaaagagaagcggctgaaggagcaaaagctgggccccggctcctacaacctcaaagacttcttagaacagctgcgggagaaaccatgtagcacccgggggctgctcagctctggggaggttcgcttccgaggactcactgggaactactatccaggccctggaaattatggggagaagggtaacccatacaccaagctggaggagaatgcctggaaccggtctcattccgagggcctcatgtgcaggatgagcaacaagccacacccccggccttatcaggggagtggtctgggacccggcacctacttcttcaaaagcgaccttgagacatatgtggcacgatccgtcggcacccgcggcccctatgacactttctctggtgatcggagcaagccactgccttatgggcactactccatgcagaaaaaaaagcccagggaactgatgaatttcaagagctttgtagaagaacttaactcacatcacaataagaagcatggggttttttctaaacttccccgaaacccgaaaacccctacagagaggatttactgggccaacctcagccagtgcccccgcacactggccacatctggccccagtttctggcttccacaagagaagaaatgcaaacccgtcaaccagcccccattcctgttgacctccaaggggtcaggtgcaaaggcctgccagatgattatgggaagctggaacccagtaggtgtgggccgctacctcaacacctggctgatggagacaaaggacaggcggcagcgatatcgatccctattcctgagtggatccaaacgctacctctcagacctggcccgggacatgctcatgcaggaaaggatcacaccatttactaagggaaagtgccctccaactgtggattacaattcagatcctactccttaaagccacatgcgaaggacagcctgcagtgaccagagagcccaaaggcctgaagacaaatctgggggtgacagcatgggcatgggagtggggtgtcttagagaaaggacacatgggcttgggagaggggagagatgtatggggatcacctttgccagagctgcatacctgaaggtcacagtgtcttccgggacagctggggacaggtatcttttgttgcaggagatcaattatcctgagaactcaactcagccagtgacatgaacatgggggccagagagcagatggactgaagggatgggacgtagttgacacttgtgggaccctttctattctaaagccagagtgcttggctccttgtttattaaagttcagaaagtgg

SEQ ID NO: 977 - DNA, 2797 bp, Homo sapiens
agaaacagctcttctggcatgatggtgacctgccatggaaaatgctgggtcccaatgcccaagtgactgtagttgtggctcagccaggacccgaccatttagatcacctgttgttagacacgcaacactgtcaacatagttcctgtgggtcagcagcctgtacacagcttacctgggtcccctgcttggggggatctcacaaggcttcaatcaagatgtcagcccaggctgtggtctccactgaggctccgtgggaaagaccctgcttccaagctcacctaggttgtttgcaaaattcggttctttgcagctgtagaatggagggcttcagtttatttctagctatgctgtggggcggggtgggggagctgccctcagatcctagaggtcacctgcaattccttgccacttgactatgtccacagaggtggtccatgcatttctgcttcctttgccaaagccagcaacaagagactccaacaagacacatcctaccatctcatgtatgcaatcccgtgcaggcaatcatggacatgtccatcacatacataaccacgtccattccatcacctttgctgtattctattggcccactcaaagggtgtggactaattagggagcgagaatcagccctcttaagtcagccctctctatttcatgtgccaactctctagaatattgatccttttggtattttaagtcatatctattgtcactggaaatcctttttgaagtagaaaggacagagctcacaaaatacaaaccgcgccactattcctgcctgtcatttagagttttgccaggggagcaggttgatttcagtcttttcatggagtttactgtttgatatgatgatatctttacccccataattaattttatttttagttttgagacatggtctcattctgtcactcaagctgtagtgcagtggtgccatcttggctcactgcaacctcaaccagcccaggttcaagagatcctcccacctcagcttcctgggaccaccccagtgggatcactggcgcaaaccactatgcccaactaatttttaaaaattctttgtagagagggggtttcactatgttgctcaagctggtctcaagctcctgggctcaagcaatctgcttgccttgggctcctttgggatcccacaaagtgctgggattacaggtgtgagccaccacacctgcccccgccccataattaattttaagttaatctccacatttcattatcttgggctagatttcgggggaggggcctaatttagctggcatgtgccccattgggtgaatcgaataaaagcatagctgccctggcatggatctgtgaacaaaagttctctgaaaagaaatttggaagaaagacttcattcaggaacagttcacaaactttctgtgtaaaccagttactttccagagaacaaagggaggatcctggttttatagtaaaagttcatgctcaggttgccaatcaggtccattttatgaaaatgaaggctttaaatttgcttagttctgtttggttgatgcagctgcattctgattagtggttagaactgagccctaattggttctttcagatgagctctgattggctgctttaggtgagctctgaaagccccactgttaaactgaggttgggggtttccagggaaactccgagtatatgagttctagtcagcaaatggcctggccacttggctctctttaaaattttggcccagttaggtacttgggatccatcttgaaggattggctcttgaaggatttgttctgagaacacttgtgaacttgagaggcccagtaaggcagagtgaaaaccagaacgcttggcacctatcagttagcacaggatccttccctggaacatcagcatcccttataagtgtgtctaacggccaactcgtagacagagctattgttaatacactgttctgagtatccctctgtgaacaccttcatctggttgatacaggaaaattaaggaagacaaagttttgggaaagtgattgaaatcgtggaataatcaaagcaaatcaatggcagcttgtgtttaaaattaaaaaccaactgtcaagcatggcatttacctaaagtaatttccaaaagtaatcaacagagtgaacaacacccagtgggccaggaccatgtcaacgttggctcattttcagaaacaacatggtgtcagggctccatgttcatggacaccatgaggggagtctcctagcaatgaccctcttctctcctgcaggaagtccaaggtcctttgcatggcagtcttatccccaaatggcatttgctttcgacccatggtatttccatattccatgaagaaaactttaaaaatataggcaaatcaccctgcaagtatccagagagtttccagggggtttctcacacacacacacacgcacacacacacacacacatgtttagtggggatcttttaggtcaatacatatagatctacatcattattagttgttgcttggtgggccactgcatgaatggttaataattgtttaatttttcctagttagacaataaagatttttaaagaatatatctttgcatacttgcttatttatttgattaggataaattcctgaaattggaattgttaaaccaagaaatacgcatatttttaaggcttttgttatgttttgtcaaatgatcctcagaaagaatgtttattaattcacatttccactagcactacacgatagaactattgggtattttttatgctgttacctttgctggttttataaataaaatattctcttgttctt

SEQ ID NO: 978 - DNA, 2884 bp, Homo sapiens
aaaatgacctctgagtcttacacattctgcctgctaagagtgattttgcatgcctgaggcctcgggccatgctgtaccggtgtgactagaaacagctcttctggcatgatggtgacctgccatggaaaatgctgggtcccaatgcccaagtgactgtagttgtggctcagccaggacccgaccatttagatcacctgttgttagacacgcaacactgtcaacatagttcctgtgggtcagcagcctgtacacagcttacctgggtcccctgcttggggggatctcacaaggcttcaatcaagatgtcagcccaggctgtggtctccactgaggctccgtgggaaagaccctgcttccaagctcacctaggttgtttgcaaaattcggttctttgcagctgtagaatggagggcttcagtttatttctagctatgctgtggggcggggtgggggagctgccctcagatcctagaggtcacctgcaattccttgccacttgactatgtccacagaggtggtccatgcatttctgcttcctttgccaaagccagcaacaagagactccaacaagacacatcctaccatctcatgtatgcaatcccgtgcaggcaatcatggacatgtccatcacatacataaccacgtccattccatcacctttgctgtattctattggcccactcaaagggtgtggactaattagggagcgagaatcagccctcttaagtcagccctctctatttcatgtgccaactctctagaatattgatccttttggtattttaagtcatatctattgtcactggaaatcctttttgaagtagaaaggacagagctcacaaaatacaaaccgcgccactattcctgcctgtcatttagagttttgccaggggagcaggttgatttcagtcttttcatggagtttactgtttgatatgatgatatctttacccccataattaattttatttttagttttgagacatggtctcattctgtcactcaagctgtagtgcagtggtgccatcttggctcactgcaacctcaaccagcccaggttcaagagatcctcccacctcagcttcctgggaccaccccagtgggatcactggcgcaaaccactatgcccaactaatttttaaaaattctttgtagagagggggtttcactatgttgctcaagctggtctcaagctcctgggctcaagcaatctgcttgccttgggctcctttgggatcccacaaagtgctgggattacaggtgtgagccaccacacctgcccccgccccataattaattttaagttaatctccacatttcattatcttgggctagatttcgggggaggggcctaatttagctggcatgtgccccattgggtgaatcgaataaaagcatagctgccctggcatggatctgtgaacaaaagttctctgaaaagaaatttggaagaaagacttcattcaggaacagttcacaaactttctgtgtaaaccagttactttccagagaacaaagggaggatcctggttttatagtaaaagttcatgctcaggttgccaatcaggtccattttatgaaaatgaaggctttaaatttgcttagttctgtttggttgatgcagctgcattctgattagtggttagaactgagccctaattggttctttcagatgagctctgattggctgctttaggtgagctctgaaagccccactgttaaactgaggttgggggtttccagggaaactccgagtatatgagttctagtcagcaaatggcctggccacttggctctctttaaaattttggcccagttaggtacttgggatccatcttgaaggattggctcttgaaggatttgttctgagaacacttgtgaacttgagaggcccagtaaggcagagtgaaaaccagaacgcttggcacctatcagttagcacaggatccttccctggaacatcagcatcccttataagtgtgtctaacggccaactcgtagacagagctattgttaatacactgttctgagtatccctctgtgaacaccttcatctggttgatacaggaaaattaaggaagacaaagttttgggaaagtgattgaaatcgtggaataatcaaagcaaatcaatggcagcttgtgtttaaaattaaaaaccaactgtcaagcatggcatttacctaaagtaatttccaaaagtaatcaacagagtgaacaacacccagtgggccaggaccatgtcaacgttggctcattttcagaaacaacatggtgtcagggctccatgttcatggacaccatgaggggagtctcctagcaatgaccctcttctctcctgcaggaagtccaaggtcctttgcatggcagtcttatccccaaatggcatttgctttcgacccatggtatttccatattccatgaagaaaactttaaaaatataggcaaatcaccctgcaagtatccagagagtttccagggggtttctcacacacacacacacgcacacacacacacacacatgtttagtggggatcttttaggtcaatacatatagatctacatcattattagttgttgcttggtgggccactgcatgaatggttaataattgtttaatttttcctagttagacaataaagatttttaaagaatatatctttgcatacttgcttatttatttgattaggataaattcctgaaattggaattgttaaaccaagaaatacgcatatttttaaggcttttgttatgttttgtcaaatgatcctcagaaagaatgtttattaattcacatttccactagcactacacgatagaactattgggtattttttatgctgttacctttgctggttttataaataaaatattctcttgttctt

SEQ ID NO: 979 - DNA, 387 bp, Homo sapiens
agactgtatcaagcaaatctatagacatgtctgtggaaaagatgacaaaagtagaagagagttttcaaaaggccatgggacttaagaagacggtcgacaggtggcgaaattcacatactcactgtctgtggcaaatggcattgggccagagaagaaacccgtatgccaccctaaggatgcaggacaccatggtacaggaattggcactggccaaaaagcaactactaatggtccgtcaagctgccctgcaccagctgtttgaaaaggagcatcagcagtaccagcaggaactaaatcagatgggcaaagctttttatgtagagagattctgatggcatccaaaacactgctcttccattctcaacatgcctgctaacctagccttct

SEQ ID NO: 980 - DNA, 774 bp, Homo sapiens
aagatcatggccactaactacagtgccaaccagtatgaaaaggctttctcatccaagtatctgcagaactggtctcccactaagccaacaaaagagagcatctcttctcatgaaggctacactcaaattattgccaacgatcgtggtcatctactgccttctgtgccccgttccaaggcaaatccttggggttccttcatgggcacctggcaaatgcctctgaagataccccctgctcgggtgaccctgacctcccgtacaactgctggtgctgcctccctcaccaaatggatacagaaaaatcctgatttactcaaggcctccaatgggctgtgtcctgaaatcttaggcaagccccatgatccagacagtcagaagaaactcagaaagaagtctatcacaaagactgtacaacaagcacgaagtccaaccataattccaagctccccagctgccaacctcaattccccagatgaactccaaagctcacacccctctgcaggtcatactccaggtccccaaagaccagccaaatcctaagagcccacctggaagtccacgtatgctagaactctgggcagggcctaatctagctgaggtccagaaatacaaacctggaacttcatatggaccaagtggccacacactgaaaaacccgtatagcgactcagtgaaataaacaagagcccccagtcagaactgtgaaacagggaaattttggggtgggagtaaaagcaaatttggaaaataaacttttttttgttgaatctttta

SEQ ID NO: 981 - DNA, 663 bp, Homo sapiens
gggatcttatgccagtgaggctgtgctgcggctgagcgggcctcccatccctcttaaaagagttaggcatttagccatgcctcccacccgggaccctttccagcagcctacattagataacgatgattcctacttaggagaactgcgggcttccaagaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagatgaa

SEQ ID NO: 982 - DNA, 731 bp, Homo sapiens
gcgcgcccggggtgcgcaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagatgaa

SEQ ID NO: 983 - DNA, 441 bp, Homo sapiens
aggtcatagaagtttggcttctctcattgacctggaaggatgccgtcatccactctgacctgcaaaccttttgatctcaaacagcgatcttccaggcgtggccccaaatcaacagcatcagcgtcacccaggagctgcctgaagccctcttgtgggaagcaagtttgtctgctcctttctgtgagacgttcccagtcactggctcaccctgggagagacagtacgcgtgttctaagctaccaacagacttcctcagatgcagtgagtcagtacaaacacacaggcaaggttgaagaactctatggccttcgtctctcttggctcagccaggcacagttcctcttagcccaagacaaaacagcctatgctgttaaatcagtggttctaccagcttccaatcataaaaccaaggggcaataatacataaaattggaacttata

SEQ ID NO: 984 - DNA, 216 bp, Homo sapiens
atgccgtcatccactctgacctgcaaaccttttgatctcaaacagcgatcttccaggcgtggccccaaatcaacagcatcagcgtcacccaggagctggattctttcccaaaacccaaaggcccagtccagtcacgagaagacatcaggcaaaccgaaattcagggaagttctacaaaacactaaccagtactcttcaaagttctcaaggtcatga

SEQ ID NO: 985 - DNA, 1358 bp, Homo sapiens
agagaagcggccccttttggtttggagcaggggacagatccttcatacacagtagggttgggtcggctaagatgaagtactcagatctctgtatcaccggagcgccctaggggatgtgtggcattttctccttttctcttcttggtctctggattttatcgcaggcagtcgggtctcccgtgcctggcacttccttggctgtgggcaggaagaggttacagcagccctggagcctgctgggctgagttagcacttccctccgcatccagaatatctcccaggaactgccccctttgcatcgccgcaccggggtggcggcgcgggctgggggccgctgcagcaggtctcagtccctccctgctgccacgcgaggagtggggagcggcagggcctaggcgtcccgagtggaggatgagccggagacgcctgcgggtccggagctgcaccgcgcccgtgcggcccgcgccgcccgcctcccgcgctctccctttggcagcagccggacgcctggcgcgtgcaggacctggggccgcggcgctcgcgcggggacgcgggagcccagggtcggcgctgcaggcagcggggcggcgccagcaaggccagctccccggggaccctggggcagcctcgcgccctgcctgcctccctggactgagacgccgcggggcctgggcagcgctctgccggcagctggtgctggaacacagccggggctgagctgctcccggggaccctgccccttccaggtgaccccaggagaagcagccccgggccggggggcaagttccagccacccttccgggtcaagaagccacgactcctggttagggggaaacttagatttttcttttgcatggaactgctgctgtgcaagatttgccaaggcttatagggtttcattttttacttgactggtgtttgagaaaaactgcaaggaaagggtggcgaaaggaagaaacactataaactttgggggcggggacattttcttggaagtgacaagtagcctcagatctgcagttcctgggccagcgacggcatcctttgctctgacactccaagggtctggacgctgccacatgaccaacaccaaagaccccaaaagagccatggaatccacgctggcgacatccaattctgccacaggccccgtcaccttctcccacgtctttggtcagcagtgccaacttatgcaagcagctgtgcaatcattgcacaccctcaatgaccagatttcccattttattgtcaccaagtcgaaggcactggaggaggacaaagacccttttctacccactgagaaggagactctgaagagttccatgatattgatgaggcacctcttaatggatgctcag

SEQ ID NO: 986 - DNA, 3858 bp, Homo sapiens
tgggttggcttggagacccgggtacgcggcggtgcagggcggggttcccggagggggcggggctccgggtggcgcggggcggggcgagggcgggcacagcgaggggcggggcgcgggccgggagcggcgggcaggccgggcatggcgtccatggcggcggcgatcgcggcttcgcgctcggcggtcatgagcgggaaccggcctctggacgaccgggagcgaaagcgcttcacttacttctcgtcgctgagccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatattgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctacaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcctgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 987 - DNA, 3819 bp, Homo sapiens
ttttgtgttcagaactatccaggcaaagaccctggataacagctgaaatgctggtttttgtttttgtttttttattttacgagtggacacaattctcacctgagtccttggccacgtggcgctatggcggtcactaccgggaattaaccacggccaccctctcagagcgccgggcgcggactcagggacacgccggctaccacctgagccggccccatggccaggaagatcatgcaggacaaggagaagatccgcgagaagtacgggcccgagtgggcgcggctgccgcccgcgcagcaggacgagatcatcgaccggtgcctggtggggccgcgcgccccggcgccccgagaccccggggactcggaggagctcacgcgcttccccggcttgcgcgggcccacgggccagaaggtggtgcgcttcggggacgaggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatattgccagatttttttcttttttggtagaaccagatatatatgctattttcagtgatttgataacagaagttttccatttggaatttttaaggtctgttaataattcaggagatcttgtaaataaaacttctgttcccagctccacccaactttccccctcctcaaaggatgtgtttcaaccatgtcacaaaaatcatataagtgatttccatctccttctccattattccccctcccccctccgctttttaccgtatgggttccttttggtgggtgattgagggtgatgttatcagccatgacatcagcatgctggctgtgaccccggaaagactggcccccagcgacgttctcagccagcgctcgcagctgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttaaaaagagttgcatgtttaaagagttttgtactagcttttcattattttgtatctagattatcaacaatggggctaccactttccttggttttatatccatttcctcttggaagttcttgttgcttatgtgacctgttggttgttccccggactgggcacctacaggagtcagggcagacggcagatgtggctggaggtcagggctcttctgcttagttgtgttagagtcttccagcatgggactgatgggagcagtgggcattctttatcccaagggctagccaggttgcgtcatgacggaccttccccagccctgaccaccaccagaagtggaagagtggagtttgcggtcaactcagcagtgcccatggagacctgcgtggtgtcagagcagcagtatctcttggagctggtgcagacaccaaggctgcccagtggtacaacgtggtccacctcccctagggaagctgctgcactcagaggctgtcctgcccagtggcccctgagccgtgtgagcctgcaggaggcgtctgagcagagcctcaagcccggtatggcgccatctccatgttgccatcactgcgttctcacctgaagccttaatctttgcgacacctgccagtgagcgctcggtttcaataccaaagtgtgtcttcttcttttttttttttttttaaatgcctgtttcataggaccttctgaaatgatttccagaatattttatctggctccaaaataaagcacatagcaactcacctcaacccctcatcatctccaggaaagtttctgccaaagctgtggcatagccaacttttgatttggttcttgccaattgttttatgtccctaaacctcatttggatccttggggtatagttttatctttctgcttcagtgatttactgtaacttttcaaatattggttctttctgtaccatttaagtatagttgatatatgtgaggcaaaaaaaggtttcagcatggtggtgagggaaaaaggagcttagaaatcccagttggcacagcctgggcaagcgccagctcccctcagggctaacggcactgttcacacagggatcctcagaatcagcggccacctgcctccaccttctgcctggagggcatggggctgttgtagaacctatggtagcaaatgtatatgtatgagtttgtattctgtagtgttggtgtagcacagaagaaagacctgtgtcctagagagtaggccaaggtgatctgcctcttctattgggagaaattctaatttctttcccactttctcaacaagcccaatattccctccaagttcttcttggtgctgagggctgtaggaattattgaaagcttctgcctcacttagtatcgtctggggcccagcacccagcaataactctaataatgtttcttaatggtatagcctcctgagattaaatgtaaaatcaaaaattaggaaatcttggagggagtcctcaagttgtattgctttgctgtgcttttggaagaagggacgacctggaggacacaggctcctgtgtgggtcttcatcctgcctgaccggcagatcttcctctacaccttgggcaaagtctatgcgaagatggtttcttagctctccatttgccatgattttcctcccattcatcatgagggagtttctcaaaccaggagtttatatttattttttagaaaatacacacttttcaggagaaacctgagcatgattttggattctccacctccccccagtctctgcacctgggattcagctcaaggattcagtgtcttcatttttacaaaagttcccccaagaaatcagcaaccagcctctgtttcatctgggagcccctcccttggccccctgggtttgggggtgctgccctactgggaacagcgggggtctgtcacccgtctgagccgcacccccctgtgtggatttcaggaagagcctccctttctttgcgtctccctttctttaattaacattttcaaaagtaataaattcttactgacgacttgtaacttagtcatattttatacttgtagcctttaataaagccatttaaaaaatgcta

SEQ ID NO: 988 - DNA, 1041 bp, Homo sapiens
attctgctgagaccatcaagccctcatccactcctactcatctcatctgtctgagtccattggggggcctcaccggcattccctgttgtctgtttggctggggaggggagtgtctggcagcctcagcgggaaagatgagggagcaatctgatcaagacggatctaacttggcaagatgagcactctgcccctttctcctgggaaacaaagagtcagatggagttcagtatctccgccctatccatccaggagccgagcaacggcaccgccgccagcgagcccagaccactgtccaaagcttcccagggctcccaggccctcaagtcctcccaaggcagcaggtcctccagcctggacgccctgggccccaccaggaaggaggaggaagcgtcattctggaagatcaatgctgagcggtcccgaggggaggggcctgaggccgagttccagtcgctgacccctagccagatcaagtccatggagaagggggaaaaggtcttgcctccctgctaccggcaggaacctgccccgaaggacagggaggccaaggtggaaaggcccagcaccctccgtcaggagcagcgtcctcttcccaacgtgagcaccgaacgtgagagaccccagcctgtccaggccttcagcagtgcactgcacgaggctgccccctcccagctcgaggggaagctgccatctcctgatgtcaggcaggacgatggggaagacaccctgttctcggaacccaagtttgcacaggtcagctcaagtaatgtcgtcttgaagacgggatttgattttctggacaattggtaaaatgtattagaaaaatacaatgaagaaccctaaaatgttttccaaagtggtgtggtggaggaggataaaaagggccaccttttcctatgtattttactggtttcttgacactcttttcttaatcatttggaaactggtcaatattgccagatttttttcttttttggtagaaccagatatatatgctattttcagtgatttgataacagaagttttccatttggaattttt

SEQ ID NO: 989 - DNA, 1823 bp, Homo sapiens
gcaatttaagtaaaacaagatgaagcaggaaccgactctcaccatccccactcccacctccatgaattccatcggacagttgtgcgaaagcgggctggctttcgcacaaccattggtggactgtctgtcctgtaagccccccaggggctgatgccctcccagtctgcctgccctgttcttagcacagcccctggcaccccgtgtgatctcaggaaacacttgctaaacatggtatcggaggagaaacggagcccacagcttagtgcaaagacctggcggcgtggactgaggctgcagaaacgcagaaacgcgcttttcctgccagaaggggacatctgcgtggtcgggagtacctctggggcacgtgccctaattccagaaacatctaagctggagcgcagtggcactgtaatagcttactgcaaccttgaactcctggcttcaagtgatcctcccgtctgggcctcccaaagcactgggatgacaggtatgagctaccgctctcagccacaactgggttttaagagcactcctccagcccactccagtgtcttccatcattctgtgaaagcaccaaaagaggaccaagcccaggaagccgccagcaggcctctcaccagccaagatggctggaatcctaatatcaagaaatgaaactccagcaggccatggaaatgctaaggggttggcatttctgctctagagagagccaaagagaaagctctatttatatctccttgcgtttggtcgcagcctcatcaaccaaaagaaccttccgccccactcaacacatcaatcaaattggggagggggtgtgaacagcagcagcgggtgttacagaggagtctcaagggtatcttagagggtgcctctctgaacagtcgtcccctccaaatcccccccaagagaattactaggacattctccttcccccgcaagcaacggcacccccagatgattaaacgcgctggcgtcggaaagagctgggatcctggagaaactacttgtaaactgtgtgggttggtgagttatttaacttttctgagccttcgtttccttaactgtaaaatgaagacaacaccactcagctcctacagttgtccagctgaaatcacctaggtaagaacgaccagttctttggggagtaatgtcccgatggtaccattcaattgtcaagaacaccaaggcaccgtcaggcacccgggcggtatcccactctcctggaagagagcagggggttagcccttggtttcaaagtccctagggagcagtaaaccttcccctccgagagccctgagagaggaataattgccccttcccactccaacccacggcacacccgcccacatccacgtgcggctgtgcccagcatctcagaggtaggacttctcaggaatcggcgggaagaagcccccttgatggagtctggtggggttcaagatctgcaggtcccaccttccagggaacacctgcacaagtgagacctgcccgatcagccccgcgctccatccgcaaactgggcagatcccaagggtgccacgcgaggaccctgcaccttggccgctccagggcgccccccacccgcgaccccggaaatctcgcccctacctgcttcaccctcgccccacccacagcgcacttttcgggacctcccagcggcccttccccggttctctggacccccgtctccccgccctgcaacgcccccatcctggtgcccacgaaaggtcgtcccagttcccctcttctctacctcaaaggaggaggtgcaaatgaggaagcctaaataaaaacaggaaactcgatttttttaaaaagcctca

SEQ ID NO: 990 - DNA, 2544 bp, Homo sapiens
atagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgct

SEQ ID NO: 991 - DNA, 2646 bp, Homo sapiens
aggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaatttt

SEQ ID NO: 992 - DNA, 1077 bp, Homo sapiens
aggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggccaaggagcagtgaggacgcttcctctgtcctgaccgcgcctcgtccaggctgctcccagaatagttttgctgtctccttcctgcctggcaagaatgtctttactatcatctccttccttttctccgggacagcctgtttaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccaggaggaagcaaggcttcggatttggcgggacatttgcccaagtccacacagccaacttga

SEQ ID NO: 993 - DNA, 2804 bp, Homo sapiens
tcgtcacagccatgagtgagacttgaagcccgttttacgtatgaagaaatgtcatttgggcctagacatcaacaatgagaaagaggcagttctagtctcagatcgtggggcagagaaagctccttgggaacatgggagaggaacgagttggtgcattgtagaaactgcccgaaggccagcagggctggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattga

SEQ ID NO: 994 - DNA, 772 bp, Homo sapiens
gttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgtaagaactctgcctatgcttgctaaatacagatcgaattaatggtttactaaaataaaaggaagaggggatcttggggacatcgtattttaatgcagttgtcaagccagttagcatttgttgactacccaatgggtgcctaaggctgtacaagactcttacagggaatttgcagaccccagagatcaggatgggcaacatggaggccagtatcaagctgtggggaggccactgccctgagaaacacatattctaattactcttgtcctgtaacctttctgggacgtagttttctcatctgtaacaatgggtgtattatttaccactttgtctgcagccactaatgatttactttttaggttcttctagggaaaataaac

SEQ ID NO: 995 - DNA, 1649 bp, Homo sapiens
atagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgt

SEQ ID NO: 996 - DNA, 811 bp, Homo sapiens
tgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccaggaggaagcaaggcttcggatttggcgggacatttgcccaagtccacacagccaacttgaggagccacagggaattggctcaggactaagtctttcctcattccctgtgatgctggattcccctggtgctgacattgttctatttttgtaacataaaatcttcgctggagtggcaggacattcagaagcagtcaagctctcatagctttataccgatggaagtttaagccctgactttcgagttggtgatacctgctggatttgtacttcagctctgctgtttttatgctctgtgaccttgggcagagttctaacctctctgagcctccatgccctcatctgtaaggtgggaataattcctgcc

SEQ ID NO: 997 - DNA, 2500 bp, Homo sapiens
caggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattg

SEQ ID NO: 998 - DNA, 2501 bp, Homo sapiens
gaaaagcaccttcttctgggcctgcgaaacatcagaaagggattgcaggggcctggagggggctgcctgcagggctctccagatacgcgtggacaagccctgtctggaggatggggatgctggctccgggaccgctgcagggtcgccgacccaggaagggtcacaaaggacaagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtctccagcccacactgtgaagagccttgtgcccacagctgtgcacatcctgggcttcctccacaccttgtccataaactgcccctcagctaccttcagacccaggatacagacgcagcctccagaagaataaatgctccattagcagctggctggagctggctgaggctctggctggtgactctggcctctggtgtagacttccctcaggtgagtgcatggatgagagctctaccttctcctgactgcccaggcctcaggacaacaggagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctcgtggtgtgatggctgcccaggctgctccttcgaggcaggacaggattcccatgggagatatgaggaccatggtgatttccaggcaccagttatgtcccagagcatcgtgtgcctgtgcagtggggttactgatagtccaggcatcagttcatattgtcctttatggcagatcctgcacaagggggttctctgtctctggacccactctgtcagcatggacatcctttttctttttccctggtaaggacatcagaaagaaagttacccctccagtgtttggagtcttggaatccttggcctgcctgcaggcctctgaatcctcagtgtgttagcccaaggtcaccttaggtaaaggaacatttctcctggtcttccaacaccctggaaagggaggctcttcaagaataggaaattcttcctagtatctaaccttggcctgcaactatgccatacatttaattgtagaaggtatggaaagttaggactgtggtggacccagttaaatcactggacagaagccatgaggcagagccagaaccagcttctggactccctgcatggagctttctactatcccaggttgttgggtcccttctcagtggccaaagatgctattttatgagccttgaggacatgacactaagtgaaaaaagcctggccaaagggccacatagtgtatagttctatttatatgaaatgtccaggaaagacaaaagcatagaggcagaaagcagactagtgctgtgggaggaatgggggatttgggaggtgatggctaaggggttatggggttttgggggaggtaatagaaatgttttaaaattggttgtgaaggtggatgcccaactctgcgaatacactaaaaggcatcgaattgtatactttaaataggtgaattgtatgctatgtgaattatatctcaataaaggtattttttccctgctgtt

SEQ ID NO: 999 - DNA, 10265 bp, Homo sapiens
cccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactgctaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgtttgtactttatttttttgtgccttctgaaaggatctaaaacaaaaatattttgcctttttttccccacgtgtatctgaacattaagcagattggctcagacacaatgaaaaggataatccaatgtacgtgctggtgcactctgctagttgttatctctgtagggctcaggaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtctatgaattgccttttgccaatgaatggatgtatttttccaaggggggaatagtatccttgactttggcagtcacctttttgtatgtctctagaaaggggtcaaaaaactatggtaaagatgaggcttatgagtgaatacctctgggacaaaccttaggactcacaagctatgccatgtttttcaggagactcttgtaccttatctggaatctaatcttgggagaagaggaaaaaggagctaatatttgtcatttatactcactctgtgccagatactgtgctaggcattttataattgttttgtgtcatcctcatgataatcctgtgaagtagatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgagctgcacacacaccaggggaggccactggctaacagtaggacttcagtgccctgaggaaaaggctttgggaatttaggcacacgtttctctccttggaatccttctagcatctggaaaaggaacctggtatttctgcagttagataccagatgcaaccagaacaggctttcgagtgctgtgatttctttcctgggttcccaagtcttgttgtttcatcacaaactgtatctttttaaggttaaaagtcttgaccttcatgggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagagcccaagaactcctcagagttcctcttcttgcttcttgaatcacatcctctaaagatgactcatgtctccatagcaactgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacatctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacaggtaaggtgtggtcacaatcagggccggggtttccctgctcactgcggcagtgcaggggtgcttgctgagatgattcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttggacagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgcccactcggatattccgcaggcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccttaggcttgttcatggaatataagccaagtttacctctccccattttctgccctggcccacttcccactcacctccacctcattgccaggaagggatcaaaatgcctccatgccagttgttaatggctacatatttgcccttcccaagggtatttgcattttatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaagggtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatagcatcccaaaccactgtgcgacatttggcctgcagaataagaaagtcctaaggcagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaagagttg

SEQ ID NO: 1000 - DNA, 644 bp, Homo sapiens
actggcaaccaccattctactttctgtctccatgaatttgactactccaggctgctgtgcattttagagaagttcttatgtgatactgaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctc

SEQ ID NO: 1001 - DNA, 684 bp, Homo sapiens
gccaccttttgggggagagtgggtggaggatgttgtgattttacactagggagtttgggctgtcattcattcgttcagcagaccttttttgggcactctgccaggcagggtaggagaggtgcctggatggatagggcataattgggccagacagacacggttcttagccttttggagcttaaagtgtcttgagaaacgcagacagggaaaaggaacgacttttcatattgtgaaaccaggagattcatcgtagattgtgtttcatggggaaaaggtggccggctgtgctcatggagaaatttcatagagcagagaaaggcatctttttcccttcttgaaatgttggcagactaggtcctggggtcaacaataggcttgaagctctattagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacac

SEQ ID NO: 1002 - DNA, 897 bp, Homo sapiens
gagagcgggggccgcactggggagtgtgggctgggccgcaggtgagcgcgcggtcccggcgagcaggtcgggtcagcccaggccagtaacctctgagttacgggaggagtgatcgctagggtccaccccggtcccggccagatctgccagctcccctctctggcgggtgttctggtgccaagtctgggagcccaggtagccctccgcagacagggcttctcggcacctcaatgaggacggacgttgatgaggccatgaatgagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgc

SEQ ID NO: 1003 - DNA, 2817 bp, Homo sapiens
agcaaaggcatctgttatgctcctgccaccttttgggggagagtgggtggaggatgttgtgattttacactagggagtttgggctgtcattcattcgttcagcagaccttttttgggcactctgccaggcagggtaggagaggtgcctggatggatagggcataattgggccagacagacacggttcttagccttttggagcttaaagtgtcttgagaaacgcagacagggtaagccagcatcgtgcctgacacagagtaagtggttataagtgtcgaataaaggaatgaattgacttatttgggaatgattagaatgtgagcaggacggtagcgagagactttatgctgcatgtgagagatagttgtgaactcatgcgcgatatgttttaagacaggtttggaaatctgaacggacagttgctatttagggaagcatttacttatacagaggacttgctttaaaggtggaagtaaaatggagaagtattaggtttgggattcttcagaggtgcctcttttaactattactatgtctctgaatttcataaatccctgagtacaatctcagagtttgggaaaaggaaagctcttctaggtaatgaaatgccaggctgatgggaaaaaactgtaggaagctctccctaagtccagggtttggacagaaaccgtatacctctgcagtgtgttcttcccactagaaagagtgtaggctttgaaattggagaggcctgggttcaaaatcagtggctctatcacttctagtgatcttggataagttaacataatgtctgtgagcctttgtggccttcacaagagtctgggctaataattcctacatcatagaggtgttatgaggatcaaatgatgattagtgtgtaaattgtcatcatagtgcctggtgctgagacaataagcgggggagtcttggagatgctgcaattttttttttttttttaaatttcatgatgctgccttattgcaggggtccttaaccccctgggccacagaccagtggtggtcttcagcccattagaaactgggctgcacagcaggaggtgagcggtgggcaagctggcaagcattaccgcctgagctccaccttctgatagatcagcagcggcattagattctcacaggagtgcaaactctattgtgaactgcgcatgtgagggatctacgttgtgtgccccttatgagaatctaatgcctgatgatctgagctggaacagtttcatcccgaaaccatccctctccaacccccatctgtggaaaaattgtcttccacgaaactggtccctggtgccaaatatagattggggaccgctgccttatagtgttacgtctagagaacattgggattccttcaaagagaattggaaccaaagagagagggggagaatcatcttatccttggtgaggtttcgattgttcactttagatcagagatagtagtgttggagaaatacctacaggggcataaacagaaagatcttttagtggatacttttgggcaagtctcttaaccctctgatagtgggttatgtatctacctcacgtggtggacatgaggattaagagagtgagtgtatatgaagcacctagcccaaggcctggcatgtaagtgctcaataaatggtagctgtgttattataactgtgaatgatctttgataattgataatggtaataatcatttgagatggaattggccattagagtgatccaatttgtgtgtttttacattactttggtattgccctacttcaattcaggaggccctgaggccattccactccgctccccgccccaccccaccccaccccaccccccgggcttgtacagtgatttttcacagaaaatcttcaggttctgcggtatccagaatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaa

SEQ ID NO: 1004 - DNA, 918 bp, Homo sapiens
ctgggtgcggcgacttccgtgctcccggcgagcgggcggagagcgggggccgcactggggagtgtgggctgggccgcaggtgagcgcgcggtcccggcgagcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagccc

SEQ ID NO: 1005 - DNA, 2333 bp, Homo sapiens
ctgcgctccgagagagccggcggccagtgggcagggtcacagggcaaggtcccgcgggccgctgggtgcggcgacttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaaacctgattaaagtggtatctgagaaccataatgatcgaatcttatcatccaggtggtatttgggggtcttcttaggagttaggcaagtacaggcattttagagcaggataacattggtattaaagggtgccaaggagccctggaaactgctttactagtgcggttgcactgaaccctggaggcacagattcccaggaacctttttaccattattacaattggctgcagcaccttcaagtctaaatggaggtagacctcacatacacacacatagacgcctttccctataaaagtatatacgcacattcaagaaaatttggtagggattttaaaaaggtcacccatgttcccagctcgttaataacaaccgttaacattttgttgtcttttactaattctctgcataggttttagagatagttatcattactgtacatttaattttatatacttttctcactattatcattttcccattttacatggtcatcataattggttttttggagacagggtctcactctgtcacacaggctggagtgcagtacaattacggctcagtgcaaccttgacctcctgggctcaagtgatcctctcacttcagctcctcaagtagatgggactacaggagtatgccaccatgcccagctaatttttttatttttttgtagaaccaggtctcactatgttgcccaggctagtctcaaactcctgggctcaagtgatcctccggccttggcctgtagtttcttttttctttttttttggagatggactctcattctgtcacccgggctggagtgcagtggcgtgatcttggctgactgcaacttctgcctcctgggttcaagcgattctcctacctcagcttcctaagtagctgggattacaggcgtgcgccatcgtgcctggctagtttttgtgtttttagtaaagacaggggtttcaccatcttggccaggctggtctcgaactcctgacctcaagcgatcccatctgcctcggcctcccaaagtgctgggattacaggtgtgaggcaccgtgcctggcagtctgtagtttttttttgttgttgttgttgttgttgttttaaatatggagtctcgctgtattgcccaggctggagtgcagtggcgcgatcttggttcactgcaacctccacctcttgggttcaagcgattctcctgcctcagcctcctgagtagctgggattacaggtgtgcgccgctacgcctggctaatttttgtatttttagtagagacagggtttcaccatgttggtcag

SEQ ID NO: 1006 - DNA, 2547 bp, Homo sapiens
gcggcctcccgcaccgaagggaccctgggcgtctgaggccctgatccgggcgggccttcaggatgttagcagtccctgtccggttgaaggtaggaagccgaaaacccgagtgggggacgaacagacttacctcctgtcccgcaaaagatccactagatcgtcgtctccaaaacctgagagaccgcgaacgggttccagagccgcagcgttctctcagacctggcgttcaggaagattctagagagcacgggcaggtcccggaggtctcagacccgcaggtagatctcgaattcgtagacttgcaggcgaagcccagatatcgtaggctgatcctaaagactcagattcccgaggcctcagactcgcaggcagctcagaaaccacaggctcataggcagatccctgagaccacagaggctggccgagaaaccaccagcaactaagctgcattcagctggagttcctcggaacgggaggactcgcagctctccctttccccagccaggatgagggaattagacaatggaagtcgagcactggggaaagcaggcattctgcgtggggaagagctcccagctcgctgtagccttggagagggaagtgatggaaaaagaatatagcagcttattagggactcccaccctcttcaagttataaatatccccagaaccttggctacgtgcccggaagcctgttgtctctaactgtacaggagacttctctgcctgggctgggaaaggggcctttcttttgttttgcagatagatccacccactgaggaacttgaaaatttttttcaaacataactccaggccttgcttttattagtgagtgtcctgttcccagtgcccggttatttatgattaaattactgaagtgtctaaaaagaacagaaggacccaccccagccataatgcagactttcccattccttctctttccacccgcaactgtggggctaagaattcttaagatgtcacagaattataccatcctacctcatctaaagtcgatccgaggctggtccgatggtagtgggttaccagaacttaataacattaataactctaaagttagtatacaaccccccactgctaaatttggctataaaaataaaattgatctgagcaccatataaaatggaatcctggagggtcccctagaggcagtatccccagtggaaagagcgtgggcctcaaggtcagacaagcctggtttggaatccaggctgtgtatcctttggaaagtcattgaatccaggcccatttccttttctctaaaatgagggtcatcatacctaaggatgttgtgaggcgtgagtgagatgattaaagcgttccagagagtgcgctcttggatgatagccgttactttttattaaccctggctttggtggtaagggaaacttccagaaatgcttgtgggtatattggatagctcagaaaatctgggaaatcaaagtggctcaatagctgtgaggaactgtgggtgactttatcctcacatcgtgtttcttccagaaattcagacgcaacagaggttaggccagtttggtgggttccagtgagcggtgtgttgagcctagtagagcataggtacttggggttgccaaaaccccagcaagttgaggcttcacgctcagggaaacttctgggtcagaggttaataaccacgctccttggagcaaggaggaggggagcctttctgactagctgaagtaattgcaggtttctaactgggcctaaggtgagctgagggcttgagcccctcagcccagcgggggtcccttttcatcccttctctgacagattgctttgtaaactttcttaggccttccccccacccctttgccccagtgctttaagcccttctttgtcttcttgctgtttcttttattcctcaggcctgcggggcgggggcggggtggcgcccaggacgactccccgggctcagcttggctgcctgcctccttctgtaagtgctttttttttcttcacctgggaccctctagaggttggaaagagaagagaggctgggagcggatggaaagcatgactgcatctggagcccctggggggagtggggaagagggagtggaaggacagtggctgaggggcttcctgttgcagccttcagctggactcagggttggggtcactggaggaggaggtggcttcctgccccattgttctggactgcagtgtttcttgggaatacttactgtatgtggattttcagtaaccaacttggaaagctgtatttgttcccatgattcagcaaacaatgagtacctactgtgtgtagaagcagcaggacagcctgtcatcactgggaaagaggccagaagagccgtttggccagggtctccaatttaggctttcaacattatctctaaagaaggttatacattatgtcggctccactggctgatgggatcaaagaccctccttgtatatccttaaacctgtactctattaccaggccactgtgcctgtggagcactgtaagttcctaccttttaataaattttataattatcttgtgagc

SEQ ID NO: 1007 - DNA, 3218 bp, Homo sapiens
actttagtcaagtaagcacaaaaaggaatatataattccaaattgtgataaatgctatgaagaaaaggaatgtgctctgacataaaggggggaacgaacgtgatctagggagtcagagatctctccgagaagagatctgaaataggagtaagtcgagagggggaagagaatgctagaccgagggaacagtgcgtgccaaagccgcgtggcggaaaggggcgtgtgggagggtaactgcggagagggagggtagaggacgaagccggagaggcagacgaagggcaggacgcacagagccccgcggctaccgccttaggggttgtcccggcggtggggaagccattgaggagtttaacgccggaaggtggtgactaatcagatttcacttgaaaatggcacggtgtctgcagcgaggctaactgatgggaagggcccagcgaatgccaataggagagagcaccggacctggaaggcctgggtcaacgcggccccgcgcgggggcgaagcggttccggcgcaggggcctggcgcggggctccgcggaaaaccgaaccggcccacgtgggaccggtcgctccgccctgctgcgcagacgccgcctgactccgcagtccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccgctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacctatcctgaggaggagctcctctgagtcaccctctgacaaccaagccttccaggcccctggatcccctgaggaaggggtgcgcagccccccagagggggcagagattcccggggctgagcctgagaagatgggtggtgctggcacagtctgctcccctctggaggacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtataaatgagcttaagtgtgctgtgtgcacatgtgtacacacagctaatttatctgcagacctatatgtgagcatgtaagagtgaacatatgtgtgtgtgtgtagtatgtaagaatgaggaactcggtatgtgcatgtgtagacaggtacccagcagtgtgtgtatatgcgcatgagtgaggatgtataggcagaagatgtgtgtgtctatgagtgagtttgagtgtgcaggcttgtattaggtgtatgtgaggaagcccttgtgtgtgcaggggtgcacatgtttggccacaggcatgggaggtgtatgttaggagcatgtgtgtttgtaggcagactcatgagcaggtgtgtgcaaatacatatccagctgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattaca

SEQ ID NO: 1008 - DNA, 885 bp, Homo sapiens
acccacgcctggaccgcggagacgcccaggccgaggaacccccagcccagggactagacaccaccagggccgggcggagccagagccagacgcgccggagcgggcgcctctacgccgctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacctatcctgaggaggagctcctctgagtcaccctctgacaaccaagccttccaggcccctggatcccctctggaggacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtat

SEQ ID NO: 1009 - DNA, 2595 bp, Homo sapiens
atgccggatgcccagttccacagaatcatggcaagcgagaaactgtcgttcataagagttcaagaaaatgaatattctctcaactctgtgagggccagtgggttccagagggtgctcaacttgctggagtcatctctgctatggctttatttgccaacaacagagaacttgctctgcagcagccccaggctctctggggaccccacaggctatgcagatcccccaccccagaaccacagaaggagacagagcagaagcacaccccgtcttccaggcccaggacagctgctgagctccaggacacggactcttgaaggttgattttgactacttactaagctccagctgaaccagttccacttctttaaccttcccatgatccctgtgaggggtctgtggtattgctatttgcaagtaaagaaagtgagattgagggaggctgaaagacttggccccaagtcacaatgccctgctgaatgtggtgctgcctcctggatatcctgggtgcttcaacatcaacagctcttggcaagtgagtgggccacgaaggatggacgagggacatgggggagcaagcccagctgcacggttccagctctttccgccacatcacagcttctgcagttgggaagactgaacagtgatcttcagtttgttcgtcaaagggccaagaaatctgtgtcctcaccttctctgcttcaattctggtgctgcttaagccgattatcatttcatgccctaaaccaaaaaataaactctacaaacatcaacattacataggacaggatctggcccacagattgggggcaggagctgctttttcaatgagaagaatgaacagacctagtgggcgttgcctttagacccaggtaagaggaatcccagccttgggacattactttcaagggccaagcccataggccatccttctagaacattctttgggtagctagggcttcataagtcacttactgggtttgtcctccttgagtggactgtgttgtcggtgtgcacacctgtatttccatggaatggtatcttagtcctgctgctataacaatacctgagactgaaaaatgtataaacaatagacatttatttctcacagttctggaggctgggaaatccaagatcaaggcaccagctggtttggtgtctggcgagggctgctctctgcttccaaaatggtgccttggggctgggcgtgatggctcatacctataatcccagcactttgggaggccaaggcgggcagatcacctgaggtcaggaggttaagaccagcctggccaacatggtgaaaaccccatccctactaaaaatacaaaaaattagccaggcatggtgatgcatgcctgtaattccagctacttgggaggctgaggcaagagaattgcttgaacccaggaggcagaatttgcagtgagccgagattgcaccactgcactccagcctgagtgatagagcgagactctgtctcaaaagacaaacaaaaaaccaaaatggtgcctcattgctggatcttccaaaagggatgaacgtatgttctcgaatgacagaaaagacagaagggcagaaagtgtccaaactcactccatcaatcccttttataaggtgctaatcactccctaaacaccccatctcttattactgttgcactggggattcagtttcagcatgagttttggagggatacagacattcaaaccacagcattgtgcacactcctttttctatggaatggccaaggtgcagctatttgcagaggctctgacagagctccgctgtggagctggggtgtccacatgcctgtatggaagaactttcatggcaccggagcctggtgggaagagaagtgggctgggctatagactgggcaccagggactatcacctcgtgccaccacatttagtgtagagttccagagaggccacaaattcttcatttgaactggactccccagcctcatgttcctctgcaggatgtaaaaggtaatgccagcagacgttggcagtgctggagacacctggtgggcagaggttacctggctggagtggcaggtgtgaggagatgcctcccagcataaggaatgtgggcttctgttggatctcttgttccaggcctcacacatgttcaaggcagcctgggtatgtcttggcccattcaatccctcaaagccctgtttaattctcatcttgctgtcacctatgtggtgccaagaaacaagtcaccaaaataatgaaatgcctacctaagcttaaaaacaaaaccatgaggtctttctaaataaattatgaaaaagtgcaaactgcaggtccctgtaatgatttcaaagactccgttccaacaatgcattaatttaaaaagggagtataaggcaaaggggggtgattagaagaggaaggcagctgacatcaaactgaatataccaagtttcctcctcaaaaacgagtgtgcattatttgtggtgaccattcttggtattgttctattacgtaaaacacagcatagcatcattcttttagatgccattcatttaatatatgggcaaatgtacatggttaggctagactggagcacttgtctacactgctt

SEQ ID NO: 1010 - DNA, 4710 bp, Homo sapiens
gttgccatggagctgcccgccccaaaccacgccgccggcgccgcggagggcaatcgccaaggaccgccgcctgcctgagcagcccggggtgtctgtgcctccggagcccgagaacctgggacccaggccagccagagctaatttctatctcccagcatggaggatgacggcagcctgctccctgaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagaggggagctgcgcgcctgtcggcagaggcgggacctgatcgacaagcagcaggaggctgtggcagccgagatcgccacagaggaagaggcgggcaacatggccgctgtgggccgcctccaggccgtgtccagacgcctgtttgcagagctggagaacgagagagacctgcagtcgaggactgaggccgtgctgaaggagagcgagaacaccatgtggcacatcgagatccaggaggggcgactcgaggccttccggacagctgaccgtgaggaggtggaggccacggggcggcggctccaggtgcgcgcagccgagcagctctgcagagagcaggaggccctggggaaggtggagcggaaccgactgctgaggatcaggaagtccctgaacacccagaaggagctcgggctcaggcaccagaagctgctggaggacgcccggaagaaccacaaggttgccgtgcggttcctgaaggcctccctgggaagaatccgagagcaagagaagaaggaggagatggagtgccacgagtacatgaggcgacgcatggatgcggtggtggcgctgaagggcagcatctccgcgaaccgggacacactgcggaagttccaagcatgggaccgtgccaaggcagagctggcggagcagagggtccaggctgagaagaaggcgattctggcccagggcagggatgcattcaggcaccttgtccaccagcgccggcgccaggagctggaggcccagaagagggcctttgaggaggagcagaagctcagaaagcaggagatcatcagtcggattctgaaagaggaggctgaggaggaaaagaggaagaaacagcatccccccaccagtgccaggcaccggctgaccctgagggacaagacctggaactacatttctgacttttgcaagaagaccacagtcccaaccaacacgtacacactggactacgaggctgctgcaggccccgggccctctcggttgctggaagtcgtttccagtgagcttatccagggggaccccggggccagctcagaggaggaaacgttagctgagcccgagatctctgggctttggaatgaagactacaagccataccaggtgcccaaggaggacgtggaccgaaagcccgtgggcgggacaaagatggacaaggacatcctggagcgcacggtggagcggctgcggagcagggtggtccacaagcaggtggtgtgggggcgtgagttccaaggacgccccttcaacagcaaaccggagctcctccacttccaggactttgatattggcaaagtgtacaagaaaaagatcacgttggtaaacaccacctacacgatcaactactgcaagctggtgggcgtggaggagcacctccgggacttcatccacgttgactttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgctgtccctcgacaaggagctcattgacttcggcagctacgtggtaggagagaccacgtctcggaccatcacgctgaccaacgttgggggcttgggcacgactttcaagttcctgccagcttcagagccctgtgagatggacgactcccagtctgccctgaaattaagcagtctcctgacctacgaagataaaagcttgtatgacaaagccgccaccagcttctctgagcagcagctagagggcacggagtcctcccaggcggacatgcagagccggaaggagctggagaagctggacaaggagcaggaggaggagcagcccgcaggtgagccaggctgccaggccaagccagggtgggcgggcggtgagggcctcagggcagcattccagggggctgaggggcccaggggagggctggaaagtagagaattttcctaggccttcgatgttaagtgacggttaagcaagaaaatattcttatgtgccactaagtgttgtttttggagtggacgaaaatgtacattcacgttgacgctaaccgaagacttgaaggcacctccagcattggcccagcaggcccagcacgggcggagccgcacagggcggggaagaggctctgcggtgccccctggaggggccgggctgcggggggcttctgtctagctctgcagctgtggctgttgttagacgcgcaccagcggggagaggtgccgagaaacgggcgggccctgccctccccatgcctcctgccctgcagcccgccgccatcgggaatcgcttgcgtctcctccttgcttctcttgatcgttttcccacatacgcatcgagatccagaaacctccgtcctcctcctgtctgtcttcgcgtggtgcgcgttccgcacgccctgcagctcagcgcggagctgggccggttctccacagcctgtgtgagccgcacttccggtgtgagccgcacttccggtgtgagccgcacttccggtgtgagccgcacttcctgtcctcaccactgcgtggcgtttcctttcctgagagagcctcgggttctagatccgtccttctgccagtgcacacttgggagcgttcgtggtacacactgttgcgaaggccgttctgcactgccccttggcctgtgtgtgagttcccacagggcacctggctggggctcatgcctgcatcacagggcatagccagcctcactggcatcagctaataccaaagtgagttctttttatgttgagacagggtctctgtcgcctaggctggagtgcagtggtgcagtcacagctcactgcagcctcgacctcccgggctcaagcaatcctcctgcctcagctcctgagtagctggaactacaggcacgcaccaccgcacctggctagtttttgtatttttttgtagacacagggtttcgccatgtttcccaggctggtgtggaactcctgaactcaggctgtctgcccacctcagcctcccaaggtgctggattacaggcatgagccacctcgcctagcccaccgagttctttttcaaagtggttgtgcaagtttacactcccaccaacagtgtacaagactgtgctgtccagcgtggctgtcactgccacatctggctatttaaacttaaattgatccaaattaaataatagtgaaaattcaggtcctcctccacaagggccacatttcacatgctccatagcgacctgtgggcaacggctgccctactggacagcccagaagcccagctctgcctggtcacagagggtcctacggggccacactgggcttgagggccttgcttcacatccgcaggagcacgaggtcacacggcccggggctgcttgtctggggggcctgcaccacggtctgctgttgagatgttgctttttggtttcccagatcaccagtgagattgcgtgtctttccctgggcccatttacaagttgtatcttctttggtgtgacatctctgtttaaggctatcccttgttcttctgtgggattgtctgtcttcttctcattcattcataggagctcttcatgcacccagattccagccctcctccctgaggaatgttgcaggtgctgcctccgagtctgtggctgggccttcctctccctttatgacgtcttttctcaaatcaaagttcttcagtccagtctttgcatatttaccagtcatttctattggaatttgttttttatgatttttaggcaatttttttctcctccagggtcataaagacataggacatcgcttttgtgttgaggtgtatgatccacctcaaattcactcctgcttgtggtggaagtcagggctgaggctcatttcccctggtgcgtgtttgtgtattccacggcacaagtggactctgctatcccattcgatccattcgttgtccgtgtcaaaaatcaattgaccatccaggcacagtggctcatgcctgtaatcccagaactttgggaggccgaggcaggaggatcacttgaggtcaagagtttgagaccagcctggccaacatggtgaaaccccatttctactaaaaatacaaaaaattagccaggcgtggtggcgggcgcctgtaatcccagctacttgggtggctgaggcaagagaattgcttgaacccgggaggcggaggttgcagtgagctgagatcgcgccattgcactccagcctggcctataagagtaaaatactgtctc

SEQ ID NO: 1011 - DNA, 339 bp, Homo sapiens
caggccagccagagctaatttctatctcccagcatggaggatgacggcagcctgctccctgaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagcgtctcctaa

SEQ ID NO: 1012 - DNA, 702 bp, Homo sapiens
gttaagagacccaaagcccggagagtgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttagttgaccacggcatgtttgagaatttgaacacagccctcactccaaagctccaggccagccgctccttcccccacttgtccaagcccgtggcccccggctctgcccctctgggctctggtgagcctggggggccaggactctgggtgggcagcagccagcacctcaagaacctgggcaaagccatgggggccaaagtgaatgacttcctgaggagaaaggagccctccagcctgggcagtgtgggtgtgacagagatcaacaagactgcaggagcacagctggccagtgggactgacgcggctccagaggcttggctagaggatgaaaggtcagtcctgcaagaaacatttcctcggctggatcctccacctcccataaccagaaagcgaacccctcgggccctgaagaccacccaggacatgctgatttcatcacagcctgtcctcagcagtctggagtatgggacagagccatcacctgggcaggcccaggactccgctcccactgcccagcctgacgtccca

SEQ ID NO: 1013 - DNA, 1049 bp, Homo sapiens
gcctggcggttccagggtgcacaccactcctcgtagcaggtcccctgtcttgtgtgctgtgtccccccgaggtatgctggtgctggtggcccaggcaggaggtgacactctcaaagtgactggtcactacgtaaaatgtgtctttcttttgtttgtttcccacctgctttccgagcccctttctcggacagttgaccacggcatgtttgagaatttgaacacagccctcactccaaagctccaggccagccgctccttcccccacttgtccaagcccgtggcccccggctctgcccctctgggctctggtgagcctggggggccaggactctgggtgggcagcagccagcacctcaagaacctgggcaaagccatgggggccaaagtgaatgacttcctgaggagaaaggagccctccagcctgggcagtgtgggtgtgacagagatcaacaagactgcaggagcacagctggccagtgggactgacgcggctccagaggcttggctagaggatgaaaggtcagtcctgcaagaaacatttcctcggctggatcctccacctcccataaccagaaagcgaacccctcgggccctgaagaccacccaggacatgctgatttcatcacagcctgtcctcagcagtctggagtatgggacagagccatcacctgggcaggcccaggactccgctcccactgcccagcctgacgtcccagcagacgcttcacagccagaggccaccatggaaagagaagagagaggcaaagttctgcccaatggagaggtttccctgtcagtacctgacctaatccacaaggatagccaggacgaatccaagctaaagatgactgagtgcagaagggcctcctcccccagccttatcgagaggaatggcttcaaactcagcttgagccccatcagcctggctgagtcctgggaggatggcagcccccctcctcaggcacggacctccagcctcgacaatgagggccctcacccagacctgctgtcctttgaatagagcctctgctctttcctgctgagctctg

SEQ ID NO: 1014 - DNA, 4118 bp, Homo sapiens
actggaaagttcaagagtgtctttgctggctctttcttgaatatttccaaagccttggaagttacaggttttgggtgtgggataaggaaaaactgaatgatagagcacaggtaccgctcccctttcctcatcatgcctctctgtcgcctctttgttcatagttgaccacggcatgtttgagaatttgaacacagccctcactccaaagctccaggccagccgctccttcccccacttgtccaagcccgtggcccccggctctgcccctctgggctctggtgagcctggggggccaggactctgggtgggcagcagccagcacctcaagaacctgggcaaagccatgggggccaaagtgaatgacttcctgaggagaaaggagccctccagcctgggcagtgtgggtgtgacagagatcaacaagactgcaggagcacagctggccagtgggactgacgcggctccagaggcttggctagaggatgaaaggtcagtcctgcaagaaacatttcctcggctggatcctccacctcccataaccagaaagcgaacccctcgggccctgaagaccacccaggacatgctgatttcatcacagcctgtcctcagcagtctggagtatgggacagagccatcacctgggcaggcccaggactccgctcccactgcccagcctgacgtcccagcagacgcttcacagccagaggccaccatggaaagagaagagagaggcaaagttctgcccaatggagaggtttccctgtcagtacctgacctaatccacaaggatagccaggacgaatccaagctaaagatgactgagtgcagaagggcctcctcccccagccttatcgagaggaatggcttcaaactcagcttgagccccatcagcctggctgagtcctgggaggatggcagcccccctcctcaggcacggacctccagcctcgacaatgagggccctcacccagacctgctgtcctttgaatagagcctctgctctttcctgctgagctctgcccttgtcttcctgctgctttctcctccactgcgcacactggccctggcctcaactccgctgtgccctttgtcttccttgtatgaggcaccagcagagagccagtcgtccatcatgggattttgcaggactggaagtccttgagtagttctagttaaagagtctatccgcagaatggctgaaggacttgatgccgttttgagcctaattttctgtaacctcctctgagtgggctgcagcccttggacattagagctcttccactcttgagcttgtcctgtcttctcagtgaattgcagggccaccagctcaggacaatggatcttacaggaattctttttgcctgtcccctacatgcgcctcctcccctgctgttctccctcccacacccctgtcccttctctctcctccttgatgggtccgatgcccctggcctcagcgggaggaaggctggatgaggaatgatgtgtttggcttgatgacaggccatggcctagaaagccacacaccctgaccacagcccagccatagctcctcttggtcccaggacagtgcaggcccctggttgccatgtttgctctgcccctggggtggaggccagaggagatgcttaccaggcctgagaccttgagagttcacccagggtttgaacgctgccacccagggttcccaaggtttctcccatctggtcagatgtcgaacacaaaatgtgggcattctgcacggaaggaaagatcaggcttctcttgctgagtgtgtgaagacagggagagccaggccccagcagatgcggcctagcacactctgatttggttttgtggggagggcccaggaacttgggggtggtcttggcattcagagctggtgctaaaaacccagagcagaagcagggagaagggagtgaggatgggacagagaagagcgaccactggggatcagaacagcttttcaggggccaccttgcagcctaaaataatgccgtttcagggcctgggcctgctgtgagagccagaatgaagcatgtacaagattggaatgtgagaagaactgtggggggaaaccagttttaattaagtggaagtgctttgtgcttgtgctgaagttgcctgggcctcctgcagctctggacctcactggagcggccccgccctgcccttgcctgcctttcttttatgctgatgctggtgggctttttcctgcttcaggatccatgtaagggactgaccaggttcatccagccttaactggttcctgcaacccacttttaggtctcccaccaggggcctattgtgctgtcttcctgtgaccagcagatcctgtaagggggtgatcctaattctggggctctttgcagcaagaggagaacgttctttttcttgaacaaggtggccggttccctgggagaaggctgggaatggcacgtccggccagggcaggcggtgcggcatcctcctcctgggattcctgtggcctcccctgttctattcattgtttggcttcccacccataagctctgggatacccagggcttgcttcccagctcttctcatctccaagcctctgctccccttcccaccaccactgccatataaaatggccatgctaactcctacacaactaggagcctcagcaggattgctaggatgtgggttccttcctgcatgcttgcttctgcagctgtgtggccttgccatggccctcccaccactttcccttctaccttgccttccattgtcttccttctcccagaaagccaggtttcaccacgtgctcaccacaaactgtctcccctccctcgtaggagtcactgcagtagggcacctgcaggccctggtagagtgagcagggcttacgtgtacattctttctcactctaaggatgtgatatctgaccctgatgtcagagaggaggtctcaggactagcattcggggtcctttgagtgttcccagaatggtttggggtatcacacaaaacaccagagctgaggatagggatagagtccccaaacacacatcctgggagcaagccacttcatctgagcttcccataccaggagcatggtttgtgctttgatgggaaacctagcaagcccctgcactctggggcttctcctctcctggagcccagggcggctctggcccgatgatatggcagccataggtacaggtattgcaggtgcagcctttcttaagtaccctgcctccactctatagcccagctgctgctggagtccaggaccttagacccaggatgagcaaaaggatcccaccaggttgtccaggaccattgccagggtgaccccagagttcttcagacctgtgtctgatactgaatacagtgccatgggaccctgctccaatctaactgcctacaacctgcccgtccccctgctgcagggatgttgctgctacctcgggaggctctctgagactggtgtctggtcttagatgctgcacatagtacctggtgctagggtctaggggctgcccaaagcccagcaggaacagctactactcatcctgcagaggccttggcccagaccagctttccatccaaagcctcacctggtttccatgtccatctcaacagtctggccttcctgtgactgtagcctggcagccacaccctcagtaatcccgcacagtgagtccagcttctctgggagcttggccttcagttagcccagtccatgagagggcagggtaatgaggaggagtaaaggacctatcttctctgtccacataaggaagttgggaccacaaggtcttttatctccttgttactccccaaccccaccataacctcctactcagcacacagctgtatcctggtagattataaggtgagcttccagaacctggcaggaggctggtgtatccccctgcacagagggaagtgtatctgaatgttgtgtatgtggctgatatggaagacatacatgtatgcaatccatcagcgtttaaagaagaagattggctccagttcggaggaggaggaggaagattacagatctattctgagtattttttagagagttaatatttatatttttagtaattttctggtagaaggaaattgcacaataaaatgatttggttt

SEQ ID NO: 1015 - DNA, 506 bp, Homo sapiens
tcccagtgggctaatccacaccagtggacttgaaacacgctttgggttgctgtatggtagtatgctaaaggacagcaagaatcacttgacaattggtttgtgaccataatggcatctataaacagaaccattgaaataatgaaaaaacatggagtaagcaaacaacatctcctggaggagataaacaaaaagcgtgaatccaactgcttggtggaacgaagcaatcaagtcagcttactgagagttcaaaagaggcacttcccggatgcctatcagtcctttactgataccacaaccaaagagcctgttcccaacagtggcaggagctcctggatcaagctgagtctccttgctcacatggagagaaagcactttccaccaaaaaataatgccatatttggataaagtgcatctccagagacacacggaaatacattctctttgattcttcttcagtgtgtctaaattatttacaaattattaattataaacaaagctaaacaaaa

SEQ ID NO: 1016 - DNA, 1818 bp, Homo sapiens
tgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggaggttggtccgcagtcattcacctggttcttaaggccagctagatttcgtggttatctccatcctggaggctgcgtggacgcccttctggaagcacgcatcccatgtcctctggggagtagtagagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcggggtcctggcgcgcaacgacatgagcatcgccgaggagctgctgtacctgcgcgtggtgcgtggcctaatggccgccatgggcaacacggaccacagcaacagccagcggctggccagcctcacgctggagtgcttcgtgcagatgttccccttggtggcggagcacgtgcgcaagtgcatgggggaggaactctaccagctcttcctgagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctgtc

SEQ ID NO: 1017 - DNA, 1685 bp, Homo sapiens
gaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcggggtcctggcgcgcaacgacatgagcatcgccgaggagctgctgtacctgcgcgtggtgcgtggcctaatggccgccatgggcaacacggaccacagcaacagccagcggctggccagcctcacgctggagtgcttcgtgcagatgttccccttggtggcggagcacgtgcgcaagtgcatgggggaggaactctaccagctcttcctgagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctgtc

SEQ ID NO: 1018 - DNA, 2258 bp, Homo sapiens
atcgctggggcctccctgcgaggctgtcagcggccgaggtgggggcccttgccggggtgaggagccgatcgtccaccggatcaggccccctgcagcagcccgcctggagcccgagcatggccgggcggggaaggggcggcggcaccggaattgctccgcccagctaaggccggggccgtggctcctgtgcaagatgggcctgtgcaccctccagcccctgggccctcctcgaaaatcctccacatcctgcgggacctggaccgccagcggcctcccaagcctgggccatttgccccgtcgcctccgcctggcattcgacttcttagaaccgcgggcacgagggcagcgtgggggcagtggtggctgtcagtccacgcgggccgccgagaggacgcgcccaccccaccctccaaacgccgtcctcctgcttcagccagagccgtccctgacatgggcccagggacgcggctgcagaggccacttccggtcactccccgctgcggcctcgcgctccgggagccgcaccctccgctgcgccagctccgaccgcagtcttcgggagcagaagcagcgccgcgcgggccctgaccccacaccctccccggcgcctccgcctgcaggaccccggccctccccgggctcgctgggtccctccgccccggccgctccccgcaccgcgcgcggtgcctacgagctccaaggcggcgccagccaagacggtcccggccaagcggcggtgggtgcgacccccaccacgggccccggcaccggcggggagggcgcgctcctaggctgcgggagcggacggacccctccgacttcggccacctggcgccgccgcctcctccccgccgaagtccctcccggggcagccgccgcaaactttccggagcgggagcgactgtgaacccgagtcctcccggcgccccgggcccttcgcgcgcctgccggtccccgtagcccggccctgcgcccgcccgggccccactactgcggccgagcgatccggcgtgaccgcgggacccacagggcgcccctgccccgcggctctctccacccccgcgcgctggggctgcggcgccgtgtctggcgcgaggctgggggccgagggtgcgtagtcgggggagacagccggtcctagggggccctttggccgggcgcgggggctcacgcctgtaatcccaaccactggggagactgaagcgggaggagcgcttcagtgcaggagttcgagagctggtggggaaaccagccccacaccacccggcgggtaccccgagtccggcgcagacaaaggatttagaaagagaatcacagtttaaccggcgggtccaggggaccagggcgtcggaggcttgctcgcggccccgagctctcggcctccacccaatttattggtttaccagctcttcgttcttagggcaaatgggaggggtgagaagggatgaggaaaaggattaatcaatgaaggagaactcgtgactcatttaataagatgtgtagccgtggcggtttctgtgaatttcctctagcaaaggcgtgtgtctaaactatttaagatctttaccttatccggactgaaatgcgtgggagcgggtttcaggagcagccaagatgtttgattgtactccactgcttcaagggagtgttatctccgccagcacctgtggcatgcgtaaagacatgaaggcaaaaaggagacttttctcctcagaggccgcccatggcttcccatggatgtctcacgcaggggggaccaactcatctggcattccagaaactctctttcccacatatgtccccctttttttgtctctattaattttttttttttgagatggagtctcgctctgtcgcccaggctggagtgcggtggcgcgatctcggctcactgcaagctccgcctcccgggttcacgccattctcctgcctcagcctcccgagtagctgggactacaggcacccgccaccgcgcccggctaattttttgtaattttagtagagacggggtttcaccgtgttagccaggatggtctcgatctcctcaacttgcgatccgtccgcctcggcctcccaaagtgctgggattacaggcgtgagccactgcgcccgactctattaattttttttttattaataaccgccattgctatttcgttcactgtgtctggcttctctaccaaggcgccgtcggcatctgtagactaaaaataaacagcataaacagacacaaaccaaaataaaatttgcaattgttg

SEQ ID NO: 1019 - DNA, 2085 bp, Homo sapiens
ggatcgcggggagcgggcagcggggacggcggcggcgcggcccgcgtgacccagcgccgcgccccgtggccccgccgcaggatgcgcgccccgccgctgctgctgctgctggccgcctgcgcgccgccgccctgcgccgcggccgccccgacgccgccgggctgggagccgacccccgacgcgccctggtgcccctacaaggtgctgcccgagggccccgaggcgggcggcgggcgcctgtgcttccgcagccccgcgcgcggcttccgctgccaggctccgggctgcgtgctgcacgccccggccggccgctccctgcgcgccagcgtcctgcgcaaccgcagcgtcctcctgcagtggcgcctggccccggccgccgcgcgccgcgtgcgcgccttcgcgctcaactgctcgtggcgcggcgcctacacgcgcttcccgtgcgagcgcgtgctcctcggggcctcctgccgcgactacctgctgcccgacgtgcacgacagcgtcctctaccgcctgtgcctgcagccgctgccgctgcgcgctgggcccgccgccgccgcgccagagacccccgagccggccgagtgcgtggagttcaccgccgagccggccggcatgcaggacatcgtggtggccatgacggcggtgggcggctccatctgcgtcatgctggtggtcatctgcctgctggtggcctacatcaccgagaacctcatgcgcccggccctcgcgcgccccggcctgcgcagacacccctgaagcgcgaggccgcccgcccatctttgcgccacctgcctgagggcgcctgagctcccaggtcctccgcccgctctcctctcctcattcctgctgcctccttaagatccccgcggaggaggacctgccggcgacggctccggcactttggcatcatcacacgccctttccagccgggcgtcagactcccagactctggccccggattggcccctgggcttgcgctgctgtgccagccgcatccagggctctccccgctctccgcaggcctttatagaggcggccagggcatggagccccttccagcaagagccatgggcactccggctcaccccgcacctccatcctgtgccgaattgtcccagacagaccgtcgccattgctcggtcactgtgctttgcaggcctggggcgcagctctccaagcctgtcctgccccgccccaccccactgggcttaggttagcttcgtgccttagtatctcgggcccactgcaggagccaacaccctctgctgtccagggggggtctgtggccctaagattggccggcctctccatgcatctggccagcgtccccttggagacaccttcaccctcaagcgctgcagaagcatgaggtgagggcctgcagcgctctgtaccgtttagggtgttggaccagccgggagcctggcaggcctggcccagcggccagggtgagtgttctcagaccccgggcagctggtggttctccagggccaggtaccccttttgtgtgtgcgacctctgactaggtccctgtgggaatggggcagatggcggccatcaccactgggtcccagggcagaagcttagataccggccttgagcagcccgaccttccaccgctgcctggatcccaagcctcagccgacccaggggaccttggtggcaacggtgtgactgacagcaccacccctagcctttgcatgcccaggggtcgagagccagtatccggcccagacaatgccacccgccatggaagaaaagctgaccctgcccacctgctgcagacccgggccccgggccgaggttgctttctgtgacgaccgcctggtgacgctggacaccaggagggttatggcactgccctcccctcctggagcccctggcactgaccacctggacttgacctgactcctggtcactggccaaacacccatcctcaccccagccaccccgggccctggctggtgccgtgtgacacctgtagcccacctgtgtgtctttgctccgcccacccctgcgtggcgccggtcaggcgcaaacctggcgccagtgtctaaatgtccatcattctcagaccaa

SEQ ID NO: 1020 - DNA, 1427 bp, Homo sapiens
aggcgcagtgcgcaggcgcccaaagccgacgtggaggtgatgcgcgggagcacagatccggggcagtgcgctgcgcagaggcgcgcggcgaagccgagtgggcgcgggagtgacgtcacggcgcgcgacgcggaggcggggtcgggcctgggtccgacggtagtgggtagcgggtctcgggttgcgggttgcaggttgcaagccgcaggccccaggcaactgccttcccggcgccatgttcggctccagtcgtggaggcgtgcgcggcgggcaggaccagttcaactgggaggacgtgaagactgacaagcagcgggagaactacctgggcaactcgctgatggcgccggtaggccgctggcagaagggccgcgacctcacctggtacgccaagggccgggcgccatgcgcgggcccgagccgcgaggaggaactggcagccgtgcgggaggcggagcgcgaggcgctgctggccgcccttggctacaagaacgtgaagaagcagcccacgggcctgagcaaggaggacttcgcggaggtctgcaagcgggaaggaggcgaccccgaggagaagggcgtggaccggctgctggggctggggagcgcaagtggctccgtgggccgcgtggcgatgtcccgagaggacaaggaggccgccaaactggggctgtctgtgttcacgcatcaccgcgtagagagcggcgggcccgggacctcggcagcctcggccaggaggaagccgcgggcggaggatcagacggaaagcagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaa

SEQ ID NO: 1021 - DNA, 2336 bp, Homo sapiens
agtctgagcccagagagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctctatgaatgagaa

SEQ ID NO: 1022 - DNA, 2687 bp, Homo sapiens
gaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctc

SEQ ID NO: 1023 - DNA, 1650 bp, Homo sapiens
agtctgagcccagagagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctctatgaatgagaa

SEQ ID NO: 1024 - DNA, 1082 bp, Homo sapiens
gagcccagagagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaat

SEQ ID NO: 1025 - DNA, 415 bp, Homo sapiens
gagagccgcggggaccatggagccggtgccgctgcaggacttcgtgcgcgccttggaccccgcctccctcccgcgcgtgctgcgggtctgctcgggggtctacttcgagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccag

SEQ ID NO: 1026 - DNA, 754 bp, Homo sapiens
gagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatgg

SEQ ID NO: 1027 - DNA, 1926 bp, Homo sapiens
ccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctc

SEQ ID NO: 1028 - DNA, 990 bp, Homo sapiens
cctactcgcacagcccagggagtggggaggataaggcgctgtcatggaggacgccgccgcgccggggcggaccgagggggtccttgaaaggcaaggagcgccgccagctgcaggccagggaggagccctggtggagctcaccccgacccccggcggcctggccctggtgagcccctaccacacccaccgggccggggaccccttagacctcgtggcgctcgcagagcaggtgcagaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccag

SEQ ID NO: 1029 - DNA, 426 bp, Homo sapiens
ctccgctctgctcctaggcgtggatggacttctgagtgggatcctggccatcatctatgtgtcagctgcttctttccacttgtgcttttattcacctggagtcccctccacatacaagggtctaccctgcccctatgcttcctgcatcttggcttccacctcccttctgaccaaaggcaacaggttcatcctctgctgcatggcctcactcatgattctcttcatgatggaccagagctactatccatatgacaaaatcctggagtctgagaactggaaaaaattggtttatataggagggcaattcagatttattattggctggaacttctgatgtgaatttgacacagtggaacctgagactgcattgggctatacttctctagttacttacctatctctattaaactgaacttgaagacaggg

SEQ ID NO: 1030 - DNA, 1558 bp, Homo sapiens
gctgtcatggaggacgccgccgcgccggggcggaccgagggggtccttgaaaggcaaggagcgccgccagctgcaggccagggaggtatgcggggcgggagtcagcagggggaagtcagctcccgcgaggcagccggtctcggggctccgcgggaggccgacggcgggagctcacggcttgtgttcctgggtgtgtgtcgcaggagccctggtggagctcaccccgacccccggcggcctggccctggtgagcccctaccacacccaccgggccggggaccccttagacctcgtggcgctcgcagagcaggtgcagaagttttttctcacctgtaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaagggtaccagtttcttcctgagccatgaccagagccattcccagataaatgaggtttcctggaaggatgttaccagtgccttatctctggccaacatggtgctggggctcttctccatcatcttcagcttcagcaggaaatgccactatgcctcccggatgctcctggtcagcttcctgttagacatggcagtcagggcaatgaccagccacatcaacatatgctccaaattgggagccgagctgaatgactttgccgtcttcaccaccttcggcttggcctccgctctgctcctaggcgtggatggacttctgagtgggatcctggccatcatctatgtgtcagctgcttctttccacttgtgcttttattcacctggagtcccctccacatacaagggtctaccctgcccctatgcttcctgcatcttggcttccacctcccttctgaccaaaggcaacaggttcatcctctgctgcatggcctcactcatgattctcttcatgatggaccagagctactatccatatgacaaaatcctggagtctgagaactggaaaaaattggtttatataggaggtgtcatcatgctgtttttctccccattgtctctgtctgctttttactgcctgatgtggtcgctctcgtacatcttctttccagatgctctgtggggcaaggcagcc

SEQ ID NO: 1031 - DNA, 769 bp, Homo sapiens
tttcttcctgagccatgaccagagccattcccagataaatgaggtttcctggaaggatgttaccagtgccttatctctggccaacatggtgctggggctcttctccatcatcttcagcttcagcaggaaatgccactatgcctcccggatgctcctggtcagcttcctgttagacatggcagtcagggcaatgaccagccacatcaacatatgctccaaattgggagccgagctgaatgactttgccgtcttcaccaccttcggcttggcctccgctctgctcctaggcgtggatggacttctgagtgggatcctggccatcatctatgtgtcagctgcttctttccacttgtgcttttattcacctggagtcccctccacatacaagggtctaccctgcccctatgcttcctgcatcttggcttccacctcccttctgaccaaaggcaacaggttcatcctctgctgcatggcctcactcatgattctcttcatgatggaccagagctactatccatatgacaaaatcctggagtctgagaactggaaaaaattggtttatataggaggtgtcatcatgctgtttttctccccattgtctctgtctgctttttactgcctgatgtggtcgctctcgtacatcttctttccagatgctctgtggggcaaggcagcctgtctttcgccacagcactgaggaagctaagcagctctaccagctcctgccggcctctgtggggtttgtgtcagcatattgggtcaagcctgc

SEQ ID NO: 1032 - DNA, 1746 bp, Homo sapiens
accaggtgggttcgcgtgcccagattgactgcttgtgggtggcatggcctcaggtggagaggcttgctgcggactcaggctggcgaatagccctggcgaacaacgggcggaggggaaggtgtctttcaagtcggtatttactctgaactgagggaagaaaagaacggaggccgcgtcagaccgagagctgctctgcggcggccagagagggaatcccaagctcttaatgggcgggggtgggggtagaaatgtctttttctattgtgtttgagaccggtaatattggggagggggagaacaagtattatcccacgcagtacaccccaatctcccagttcatttcctaatccttaaactctggtttcaaactccctcgctttgctcttcagttgcaggttccgatctttgggtactccaggagctgttctatagcccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaa

SEQ ID NO: 1033 - DNA, 1433 bp, Homo sapiens
cggaggtgggtagatagacccggagagacggcgaaggagctggaaaccgagccagggctgagccggctgacaacagttgcaggttccgatctttgggtactccaggagctgttctatagcccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaa

SEQ ID NO: 1034 - DNA, 1746 bp, Homo sapiens; identical to SEQ ID NO: 1032

SEQ ID NO: 1035 - DNA, 504 bp, Homo sapiens
atggcagcggaggagaaggaccctctgagctattttgcggcatacgggagcagcagctcaggctcctcggacgaggaggataacatcgagccggaggagacgagtcgcagaaccccggatccggcgaagtcggcgggcggctgtaggaacaaggcggagaagcggctcccgggacctgacgagctgtttaggagcgtgactcgcccggcctttctctacaatccgctcaacaaacagatagactgggagaggcacgtcgtcaaggcgcctgaggagcctccaaaggaattcaaaatatggaagtcaaattatgtaccacctcctgagacctacaccactgagaagaagcctccgcctccagagcttgacatggcaataaaatggtctaacatatatgaggacaatggtgatgatgctccacagaatgctaagaaagctaggcttctaccagaaggggaggagacgttggaatcagcacttgaagatcttgaaatccagaactga

SEQ ID NO: 1036 - DNA, 1219 bp, Homo sapiens
gcagccgtcatggcagcggaggagaaggaccctctgagctattttgcggcatacgggagcagcagctcaggctcctcggacgaggaggataacatcgagccggaggagacgagtcgcagaaccccggatccggcgaagtcggcgggcggctgtaggaacaaggcggagaagcggctcccgggacctgacgagctgtttaggagcgtgactcgcccggcctttctctacaatccgctcaacaaacagatagactgggagaggcacgtcgtcaaggcgcctgaggagcctccaaaggaattcaaaatatggaagtcaaattatgtaccacctcctgagacctacaccactgagaagaagcctccgcctccagagcttgacatggcaataaaatggtctaacatatatgaggacaatggtgatgatgctccacagaatgctaagaaagctaggcttctaccagaaggggaggagacgttggaatcagatgatgaaaaagatgagcatacttctaaaaagcgcaaagtagagccaggagaaccagcaaagaagaaaaagtagaaacaaatgaccagaatttctgtactgctaaacttgttgaaatgtttctttggacagattaagttgatattgtgggttattatgccacatctccatgaaaatgcatacgttaatgaactaataagtattgcctcaagaactttccactatagaattctttttttatttaaaacatgtatgtatttaaaactcaactggtgacttgtgattgtgaaattgataacacttggatgcattcttgctctcacagaattggtgacatgctttgagagttttgtcacatgttgacatgccaatgttcttataaaccttttataaaggaatatatttttaaagtaaatatattgtaatgtactgtgaacttgtagggtgcttttcaacagtctttgtacagtgtaaatagatcatggaaataaaattacttattcaatattactattactgtataacattaacatttgaatgtttgtctgtgacaagtaccctatttgtcgtgtgacattttaagttgtaataagaagtattaccatttaaagagtgcctcctgtgttccaggtgctttgtgcatatattttctctgatccttaaacaacctagcgcaaggtattattagtattctcattttataataaagagtgcttgagtagcttgtctgatgtta

SEQ ID NO: 1037 - DNA, 588 bp, Homo sapiens
ggcatggcggccaggcagatctgggcacggacgggtgccgcgctctgcaggcaaccttccgccgccccgccgccagcacctctctgggtaagagctgggttccgacagcagctcagcttaaccctctgccctgctaacgagggaaactgcggcggctccgcgcccagcacgcccggtaggccggagagagcggcgaggccttcggtgagcgaagagttaaccgcggcggagcgacagatcgcggagctgcacgctgccgcctgcgcggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaagctaa

SEQ ID NO: 1038 - DNA, 600 bp, Homo sapiens
aggagaagagttgctgcagctccttccctgctttggaggaggaggggaggcggggtaagtttggtgggaaactctgtaatttccttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataa

SEQ ID NO: 1039 - DNA, 3975 bp, Homo sapiens
ggttcgggtagtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgcaatggagcactcattaacaccagtgacacagtgcagcatggagctgtttatagtttggaacccagactttgcggtggaaaaggaggttttggatctatgctccgagcacttggtgctcagattgagaagacaaccaatcgagaagcttgtcgggatctcagtggaaggagactacgcgatgtcaatcatgaaaaagcaatggctgaatgggtaaaacaacaagccgagcgagaggctgaaaaggagcagaagcggctggagcgactgcagcggaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggttatcaaatttgtagacataaggttatttataatggtcccttcttacccttttaatgtctttaggagctgtgttgataatttccttttcattatgatactggtaatttctgttctcactttcctaatcaggttgggtaggggtttatcagttttactgatctgactttttattttattttattttttttgagacagtcttacactgtctcccaggctggagtgcagtggcgcgatctcggcttactgcaagctctgccttccgggttcatgccattctcctgcctcagcctccccagtagctgggactacaggctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgatataacttttaaagaaccaacctttggttttatttttctcaattgtttatataattaatttctgttattttctttcttctatttagcttgagtctcctttgatcttttttctttagttccttaagataagccttaggtcattgatcttagacgttatttaaaatacatatttaaagctatacattttcttttaagcattactttagttgcgactttacaattttattatgtcgtatttttattattcagttctaattttcttttttttttctttttgagatggaatttcgcttttgttgcccaggctagagtgcaatggtacgatctcagctcactgcaacctctgcctcctgggttcaagcgattctcctgcctcagcctcctcagtagctgggattacaggctccagccaccatacctggctgatttttgtatttttagtagagatggggtttcaccacattggccaggctggtctcgaactcctgacctcaggtgatccacccactttggcctcccaaagtgctgggattacaggtgtgagccaccatgcccagcctctgattattttctaatttcctccctcagttcttctttgacccatggattatcagaagtgggttgtctgatcagcaaacatttgttttttttcctcttaatatcttcttgttgctgatttctactttaattccattgaggtcagaaaatatcctctttatgatttcaatcctcttagttttattgagactcgttttatgacccaatatgttgtctgtcatggtgagtgtaccatacacagtttaaaagaatgcgtattttaggccaggtgtggtggctcatgcctgtaatccagcatgagattacatgctgagattacagctgtaatctgtaatttgagaggctgaggtgggaggatcatttcgagaccagcctgggcaatgtatagtgagaccatgtctctaagaaaaacaatatgtaatttgaattgttgggttaatatgttttgtaatatcgatgagattaagtggttgatagtattgttcagatcttctatgtctttactgatccttttgtttatttctatcaggtgctgagaaaggatgttaaaatcttcaattatgattgtggaattgtctatttcttaaattctaccagtttttgtatgaagctctaataacttatgtcttcctaatgtattgaccattttatcattatgaaatttccctctgtctctggtaatttgggtttgaaatctactttatcttatgtgaatatagccactgcagccttcttaagcttagtgtttgcacagtatacctctttctattaatttactttgtgcttctgtgcctatttaaagtagtttctttaaacaacatatacttgagacttgcatttttatctgttctctctgtatcttttaataagtttaacattaaatgtaattattaataggtttctaatttacatgtttcctgtttagataagattattttataattgtattttaatttattggctctttagctatactgttttaataatttttttaagttggatgttctagtgattacaatatacattcttaatttttcagtctacctagagttgatgtgccacttcacataaaatgtagaaatcttgtaagtatgtacatccatttatcatacctgtcttttatgctgtagttgtcatacatattaaatctacatatttaaatattgtaagtcctgtcataagttacaatttctgctttaaataatgatatgtattttaaagaaattaagaggaaaaaataaaatcttttgtatttattcacata

SEQ ID NO: 1040 - DNA, 1349 bp, Homo sapiens
agtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgcaatggagcactcattaacaccagtgacacagtgcagcatggagctgtttatagtttggaacccagactttgcggtggaaaaggaggttttggatctatgctccgagcacttggtgctcagattgagaagacaaccaatcgagaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaaccc

SEQ ID NO: 1041 - DNA, 3970 bp, Homo sapiens
gagttgcggcgcctggtgtctcagagaggcttgaggttcgggtagtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgccatggagctgtttatagtttggaacccagactttgcggtggaaaaggaggttttggatctatgctccgagcacttggtgctcagattgagaagacaaccaatcgagaagcttgtcgggatctcagtggaaggagactacgcgatgtcaatcatgaaaaagcaatggctgaatgggtaaaacaacaagccgagcgagaggctgaaaaggagcagaagcggctggagcgactgcagcggaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgagagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaacccaattctaactatcccctttttccttgtcagggctgtagaattaatgtctgaaaccatctgggccttaaattttctttgtctggttttctatagtgtatttaataaatatagggctattcacattttttggtttgatcttggtgtcatttaggtaatgaatctatccaagaaatctatccttttgacccaggttatcaaatttgtagacataaggttatttataatggtcccttcttacccttttaatgtctttaggagctgtgttgataatttccttttcattatgatactggtaatttctgttctcactttcctaatcaggttgggtaggggtttatcagttttactgatctgactttttattttattttattttttttgagacagtcttacactgtctcccaggctggagtgcagtggcgcgatctcggcttactgcaagctctgccttccgggttcatgccattctcctgcctcagcctccccagtagctgggactacaggctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgatataacttttaaagaaccaacctttggttttatttttctcaattgtttatataattaatttctgttattttctttcttctatttagcttgagtctcctttgatcttttttctttagttccttaagataagccttaggtcattgatcttagacgttatttaaaatacatatttaaagctatacattttcttttaagcattactttagttgcgactttacaattttattatgtcgtatttttattattcagttctaattttcttttttttttctttttgagatggaatttcgcttttgttgcccaggctagagtgcaatggtacgatctcagctcactgcaacctctgcctcctgggttcaagcgattctcctgcctcagcctcctcagtagctgggattacaggctccagccaccatacctggctgatttttgtatttttagtagagatggggtttcaccacattggccaggctggtctcgaactcctgacctcaggtgatccacccactttggcctcccaaagtgctgggattacaggtgtgagccaccatgcccagcctctgattattttctaatttcctccctcagttcttctttgacccatggattatcagaagtgggttgtctgatcagcaaacatttgttttttttcctcttaatatcttcttgttgctgatttctactttaattccattgaggtcagaaaatatcctctttatgatttcaatcctcttagttttattgagactcgttttatgacccaatatgttgtctgtcatggtgagtgtaccatacacagtttaaaagaatgcgtattttaggccaggtgtggtggctcatgcctgtaatccagcatgagattacatgctgagattacagctgtaatctgtaatttgagaggctgaggtgggaggatcatttcgagaccagcctgggcaatgtatagtgagaccatgtctctaagaaaaacaatatgtaatttgaattgttgggttaatatgttttgtaatatcgatgagattaagtggttgatagtattgttcagatcttctatgtctttactgatccttttgtttatttctatcaggtgctgagaaaggatgttaaaatcttcaattatgattgtggaattgtctatttcttaaattctaccagtttttgtatgaagctctaataacttatgtcttcctaatgtattgaccattttatcattatgaaatttccctctgtctctggtaatttgggtttgaaatctactttatcttatgtgaatatagccactgcagccttcttaagcttagtgtttgcacagtatacctctttctattaatttactttgtgcttctgtgcctatttaaagtagtttctttaaacaacatatacttgagacttgcatttttatctgttctctctgtatcttttaataagtttaacattaaatgtaattattaataggtttctaatttacatgtttcctgtttagataagattattttataattgtattttaatttattggctctttagctatactgttttaataatttttttaagttggatgttctagtgattacaatatacattcttaatttttcagtctacctagagttgatgtgccacttcacataaaatgtagaaatcttgtaagtatgtacatccatttatcatacctgtcttttatgctgtagttgtcatacatattaaatctacatatttaaatattgtaagtcctgtcataagttacaatttctgctttaaataatgatatgtattttaaagaaattaagaggaaaaaataaaatcttttgtatttattcac

SEQ ID NO: 1042 - DNA, 1465 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaactgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattctta

SEQ ID NO: 1043 - DNA, 1442 bp, Homo sapiens
agtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaatagacattgatgaagaaaatctgttggtaattgatacatgggctaaagcatcagagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttc

SEQ ID NO: 1044 - DNA, 893 bp, Homo sapiens
agtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaaaaatcatga

SEQ ID NO: 1045 - DNA, 1061 bp, Homo sapiens
agtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgcta

SEQ ID NO: 1046 - DNA, 3039 bp, Homo sapiens
acatcctggaagagtggcctaggacagctcctctcctgccagagctaggcaggcgccgaagtagccgcatggccccgtcagaagaccccagggactggagagccaacctcaaaggcaccatccgtgagacaggcctggagaccagctccggtgggaagctggctggccatcagaagaccgtccccacggctcacctgacttttgttattgactgcacccacgggaagcagctctccctggcagcaaccgcatcaccaccccaagcccccagtcccaatcgagggcttgtcaccccaccaatgaagacctacatcgtgttctgtggggaaaactggccccatctgactcgggtgacccccatgggtgggggatgccttgcccaggccagggccaccctgccgctctgcagagggtctgtggcctcagcttccttcccagtcagcccgctctgcccccaggaggttcccgaggctaaggggaaacccgtgaaggctgcgcctgtgaggtcttcaacttggggaacagtcaaggactcactgaaagccctctcctcttgtgtctgtgggcaggccgattagctggaagggccgggctctgatgcccagaggctgcaattcccagggcctggccctgcttccccagctaagcaggagtcttttgtgcttgagccaaggaaacatcattagatccgctaaggggcatctgaaacatccgtcgagtggcagaggcaggataagtcacctgcacatgaagagactcattcattcatacagcaaatattactggtacatcttccacatgccaggccctgcaaagtgctggggagataccatggttttcctggagctggtatttttggggtggagggaacccaccctgaataaataaagtaacccaataaataaagaagatgattttgaacagcgatgaatgctctgcaggaactgaaacaggatgctagagggagagtgattggggtgaagacctttcctgatgcagtgcttggtaagggcctctctgcgcaggcaacaaagtgtgatctaaaagatgagaaggggccagccctgagaaaatccaccctccccagggccacctgctgtcatcttaccccagggcaggccagagcagtggtcagaatgccccagcatgacggggaggggcaacgggtttcttgctgccatcttggctcagaggcgagtgtgtaggtcactgcaaaggcaggggataccacgtggggagactcgagggccatgccagttggggctgggaggctcagggaagttggctccaggagactccatcccataaggcagcccaggtgggacctggggatctgagatgggaaataaggggatctggcttctcaaaagggagggaggtactcaaaaatagagtatcatgtttgaacgaatgaaaacaagacatgttatttattgagcatctactgcataccaggctcatgctgccctctagggatagcaaaaaaaaaaaaaaaaggtggggggaggaggttcacccctcagggcaatcgtgttccctgagcaggaggtggagttactggtgtgggtgtgaaggtgtctgtgagtctaaggcatgcacagcactgtgagaaaccctaaagcaacctatttaaggaagtcagtctcaaagctcccagataaaaatcactgggtttttctgtatttattttagagacagagtctcactctatcacccaggctggagtgcagtggaacaatcacagctcactgcagcctcaaactcctgggctcaagtgatcctcctgcctcagcctcccgagtagctgagactataggtgcaccactacgcccagcttgacttcttttagtagagaagaggtctcactgtgctgcccaggctggtcttgaactcctggcctcaagctatcctcccgcttcagcttccctaagtgcttggattataggtgtgagccaccgtatctggtcattaatttattcaatgactattttactaggttcctacaaatactagctgctaacatttaacatgtaattgaccatttactctgtgtcagagaaacaacatgggcactgtatttgtgaccattttatagattagagagctgaggcacagagaggttgaagaatggactcaaagttccatagactggtaccattgagattagaactcaggcaagtctggtgcccatattcttgcttgtaactgtaaggtatataccctctcatcctggtagcgtctcttctaggcagaggggacacacagaggataaatgtaaccctgtcctcaaggagctcacagccaggtgggggaggccagaaagaaagcacacaattgccatagcttctgagaagtgcaacagtaagggcaacacagaatgatgctggaggacaaccagcccactctagagagaggagatcagggaggacttcctgcaggaagtgatgccgaaaatgagatctgaccggtgactaagctatacaaaagggtggggtgggggagcaagtggggagtgctctgggcagaaggaccagtcgttcagtctggctagggtaattgtcattcattcatttattcaccaagtatttattgggcatccactgaatgccaggctttgggctaaaccatgagatggagcaatgaataagacaatgaggcccagccacaaaatagtttatcctctagttgggggagacaggcaatgcacacacacaaaacaaacagatcagaaaggtggcaggaggccaggcgcggtggctcatgcctgtaatcccagcactttgggaggccaaggagggggaggcggggggagatcacctgaggtcaggagttcgagaccagcctggccaacttggcgaaaacccgtctctactaaaaatataaaaattagctgggcgtggtggtgggcacctataatcccagctacttgggaagctgaggtgagagaattgcttgaacctagaaggcagaggttgcagtgagccgagatctcgccactgcactccggcctgggtgacagagcaagagcaagactgtctc

SEQ ID NO: 1047 - DNA, 2098 bp, Homo sapiens
aggcgacccggacctcgggaccggggggcagggcgggtgtctgcagcgtcctcgggaggtctcaggccccttgggcagacgctgcgcgtgcccagagggagggatggcaggcttcagccacttctcccagccgccctaccgggatctctgggaacccccgcggcccggcggagaacgagagtccacgcagcggctgggcgggcagaggtccggagccgactccaccgcgtgctcccgggccgggactccgggtgcggagagcgaagctggggcgtgctggctgcacccgcactgttcgttcaccccgcggcctcgcaggcgcgggtgctcagattcactgcggggcagccgaagcctgagcgatgtggcccgcaggcccctggaacgttccaggaagcaccggccccgcagcaggcgcctggaagatgcctggggagagacaggaaccaagccccgcccggcttggcagccgcagacccagctgccaccccagcggccgcagccctgcccgcattaccctctggcccagggagactcgcccccgccttgccccggaggagctggcactcccctgagtggcacattcagggtagaaaaggcacagggtggagaccagtgggcagtgccactcggcagacatctaggtcgctggtccccttcctcagttccctcggagcggtcttctgtgccctcgcaaaagttcaagaggcactcagcctgcgtgtgcgcccagaagagagacagcagcgaccaggttgagtcattagccagccgggactcccagcccttggcctccagcaaagagatgcggagcccgcacacccaggtcctgaagagcaagctggaagaggtggtggtgtcctcccaggaccagcagattgtggccctggtgctgacccgtctcaagaaggcccagaggatacgggagctgcagcagcaggcggctaaggcctgggaggagctgaagcgctcggatcagaaggtccagatgaccctggagcgggagcgccggctgctgctgcggcagagccaggagcagtggcaggagaaggagcagcgcaagaccctccagagccctgagcagcgcggcctgcggcgggacagccagaggaagaacgtgcccccgggggaaagccggtggaaggagcaaccagaggaccaggagagcccgcgccaggagaagctggagaaggcgcgcgcccaggcagagcaccgaaaacagtgccaggtgcggcgcctgcgggagcaggagaagatgctacggaacctccgggagcagcacagcctgcagctgcagaggaggctggtggaagcctgtcgcaagaggcacctacatgccgtggagggccagaagaaggtccaggacaccaacctgagctccctcatcaattaccaggcccggaaggtcctcatggactgccaggccaaggctgaggagctccttaggcagctgtccctggaacaaagtttccagcggtcccaggagatacaccagggcctgaggaaggagcggcaacgcgagctgagggagaaggcccagaaggaggaagagcagttgcagcaggccaggtggcgcgcaggggagtcagaggaacagaggaagatgcgcaaaagaattctggtggagctggcggatgagaagatccgacaggccaggagtcacgtgcacaagaccactagggacaaggtgcagcacctccgggagctcaaccacctgagggagaaaaaccaccacatcctgaaactgaaagccgagaaggaggaaaagtgtcacattgagggcatcaaggaggccattaagaaaaaggagcagagggtgcagcacatttcccaagggaaagacccaaacttccaggagttccagaagctccctcaggcctccaggagagaggagagagcgcctcccaacagctcccttgatcagatggtactagaggcccagctccgtgcctgtcagcagaacaggggttactgagaaccaaggacgcctggcttacagtgcgcagccagaaggagatgtggcaatgtgattccttttgtaatctgattataattgaacattgattttaaaaaagcatgtaaaatagctgcaatttcc

SEQ ID NO: 1048 - DNA, 1000 bp, Homo sapiens
cttccagtcttgctcctatcagcaaagaggattttgcaaagccacagaacaatgtgtgaccagcagaagcagccacagttccctccatcttgtgtgaaaggttcgggactaggggctgggcagggtagcaatggtgcctctgtgaaatgcccagttccatgccagacccaaactgtctgtgtgacaggccctgctccatgccctactcaaacttatgtgaagtaccaagttccatgccagactcaaacctacgtgaagtgcccagctccctgccagaggacctatgtgaaatacccaacaccctgccaaacctatgtgaagtgcccagctccctgccagacaacctatgtaaaatgcccaactccctgccaaacctacgtgaagtgcccagctccctgccagatgacctacatcaaaagtccagctccctgccagacccagacgtgctatgtccagggtgcttctccttgccagagctattatgttcaagctcctgcaagtggctcaacctcccagtactgtgtcactgacccatgctctgctccctgttccaccagctactgctgtctggctccccggaccttcggggtgagtcccctgagacgctggattcagcggccccagaactgcaacacaggatcatctggctgctgtgagaattcgggaagctctggatgctgtggttctgggggctgtggctgcagctgtggatgtggcagctctgggtgctgctgtttgggaattatccccatgaggtcccgaggtcctgcatgctgtgaccatgaggatgactgctgctgctaaacatacgacagctcaactccagaatgcactgccccgctaccccttctggaacatgcaccagcttctggccccctctctgttagtgccagtgatgtagaacctcatcactttgcctctgtgctttgcttctctaccaaggcagcctgccagagttagtacagtccccaaactttggcatgaataaagctctgaatgc

SEQ ID NO: 1049 - DNA, 908 bp, Homo sapiens
atgtgtgaccagcagaagcagccacagttccctccatcttgtgtgaaaggttcgggactaggggctgggcagggtagcaatggtgcctctgtgaaatgcccagttccatgccagacccaaactgtctgtgtgacaggccctgctccatgccctactcaaacttatgtgaagtaccaagttccatgccagactcaaacctacgtgaagtgcccagctccctgccagaggacctatgtgaaatacccaacaccctgccaaacctatgtgaagtgcccagctccctgccagacaacctatgtaaaatgcccaactccctgccaaacctacgtgaagtgcccagctccctgccagatgacctacatcaaaagtccagctccctgccagacccagacgtgctatgtccagggtgcttctccttgccagagctattatgttcaagctcctgcaagtggctcaacctcccagtactgtgtcactgacccatgctctgctccctgttccaccagctactgctgtctggctccccggaccttcggggtgagtcccctgagacgctggattcagcggccccagaactgcaacacaggatcatctggctgctgtgagaattcgggaagctctggatgctgtggttctgggggctgtggctgcagctgtggatgtggcagctctgggtgctgctgtttgggaattatccccatgaggtcccgaggtcctgcatgctgtgaccatgaggatgactgctgctgctaaacatacgacagctcaactccagaatgcactgccccgctaccccttctggaacatgcaccagcttctggccccctctctgttagtgccagtgatgtagaacctcatcactttgcctctgtgctttgcttctctaccaaggcagcctgccagagtta

SEQ ID NO: 1050 - DNA, 1576 bp, Homo sapiens
atgcgcaagaaggtgcctgcgggactggagcagagcgggctgcgagggtcttcccagcgcaggcgggttttccagtgttacttgcggctgggcgtgggggactagctgcctttctggcagcaggcaggaagccgcaaaaagtttctgagcccccgaacctgtagcggacgtggaaaaagaacgcccctcctcaagtgtctggctgaaagatgccacccagggaagggaactcgggctagctaaggaggccattcttgatgttgcttctagatctcatgtcatcaccgagccctcagctgctggtggcagctgctcagcagacccttggcatgggaaagagacggagtccaccccaagccatctgccttcacttagctggagaggtgctggctgtggcccggggactgaagccagctgtgctctatgattgcaactgtgcaggggcatcagagctccagagctatctggaggagctgaaggggcttggcttcctgacttttggacttcacatccttgagattggagaaaacagcctgattgtcagtcctgagcatgtatgtcagcacttggagcaggtgctgcttggtaccatagcctttgtggatgtttccagctgccagcgtcacccttctgtctgctccctggaccagcttcaggacttgaaggccctcgtggctgagatcatcacacatttgcaggggctgcagagggacttatctctagcagtctcctacagcaggctccattcctcagactggaatctgtgtactgtatttgggatcctcctgggctatcctgttccctatacctttcacctgaaccagggagatgacaactgcttagctctgactccactacgagtattcactgcccggatctcatggttgctaggtcaacccccaatcctgctctattcttttagtgtcccagagagtttgttcccaggcctgagggacattctaaacacctgggagaaggacctcagaacccgatttaggactcagaatgactttgctgatctcagcatctcctctgagatagtcacactgccggctgtggccctctgactttaactctcctcccatatagaaggtactcagtaaatgatcatctctaggttggggatggcaaataatcatctcaactgccaattccaagtgtcttgaatacactaaggcacaatgctgtagatcagttggccacaaatgcaaagggcatgtaaataggtaatggtggtgctagtagcaaattggtagatagtacatacttgccatttctatactaggaagtcctcttagtggagatgttttcattttcactggataaaagatagaaggaaggagatgatagaggaaaagcagggtgatggaagacaagccaaacactcttgcatggtaaccttgtaaatatacctgctctatgtgggtgctgcatgctaggaaagtagggctgggggcttttctgcatgtttatatgcctccaactgaatttgaggagagtagaccaccagtatgcttaaatatgtgatacttgttaatgtaatacaccattcaggaataaactgagagttctgagg

SEQ ID NO: 1051 - DNA, 837 bp, Homo sapiens
tgcggccgtatgcgcggctctgtggagtgcacctggggttgggggcactgtgcccccagccccctgctcctttggactctacttctgtttgcagccccatttggcctgctgggggagaagacccgccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagaggagggattgaggccctgcctaggactcaggactcctgctgctagtcacagaataaggctgggagtggcaaggaaaagagggtcgggcacaggttggtcctctttaccctcccttgtttgcctttcttcccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcaccca

SEQ ID NO: 1052 - DNA, 1010 bp, Homo sapiens
atgtgtgggcccgagcacctgctctgctgccccaaagatctggcgatgtttcccaggcaactgtctctcacagcctgtctgcctggcactcccgtatcccataaatgccaccacatctggctatgggtgggcgtgcctgcctggcatccacgggccagcaggtgtggtggagcacagcccagttcctggctgcgtcagaaggctgcccgggccttttggctgtccttgccagcagcaaaactccgtcaccacagcagcagatggctccgaagaagtggagcgttttcatcaggttcaactttgaaacctccaccatcaccatcaccagcaccgctgtgtcatgctgataacttgaggacaggcaggacaaggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcggcgcccggacacgctctcccccgccagcagccccgcctctcggctcccccgccagcagccccgcctctcggctcccccgcatgcgcattaaagcagggcgggctcctgtctgtctctgtgttgtgatg

SEQ ID NO: 1053 - DNA, 729 bp, Homo sapiens
tcacttccgcccggcgcgggcttggatggaggcggcgcggaggccgcggctggggttgagccgccggaggccgcgcccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcggcgcccggacacgctctcccccgccagcagccccgcctctcggctcccccgccagcagccccgcctctcggctcccccgcatgcgcattaaagcagggcgggctcctgtctgtctctgtgttgtgatgaaa

SEQ ID NO: 1054 - DNA, 2313 bp, Homo sapiens
ggcgcggaggccgcggctggggttgagccgccggaggccgcgcccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggctgacccagctggatgttgacagccacctggcccagtgcttggccgaaagcacagaagacgtgacgtgtctttcatggatgtgcaagactttgaatgaccctggcagtcaagggtgagtgtcatccacaggagagccggccagccacgggctccatgggcagttgccccgcaccacgcccacgcaggcccactgtgcagcccccaagtcaccagagttttcgagaaccacttccaaaagacaccgtcgtgaccggagccattagcaaatatcaggatttttcaaaccacacttcaatacatccttcactttaatttataaaacaaattactgaatataaaagtctcccctctgatgagcacagcattactcacatattgtgtacaagaacggccaaactggtaaccggcacgctactggcaacacggcagtatttagccaccagccgcacaatggggtggagcggcccctgagtcatggaggcctggggtctctgcgcctggccaagagggctgcgtggcaatttccacacctgtgcaccaggcctcactcagaggcatgaggtggcgcgaccccctctcccagggagctcagaagacggctctgccacacctgacacctggcagctggcagccctgcctctaggaagcctcagctctggacagctgtgccttcacctgaggggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggaggggggtgaccgtgtgttcattcccttgggggaagcggagtcacgttcgcataagaatcctcccccaacgcccactggagagatgacaccaggcgggtgggactcaagggcaggctgggtcaccagctgcccaaggtgccggcctgccatggggctgcccgaggggtgctccagggacccgcacccagtgggactcactcatcgtctggggtcagctgcacgggctcgctggtgaactgtgtgtcaaagttgtccagaccgtagtcgtctgtgatctgtggctggaatggagggagcgcctgcttcttctccagcttggaaaaacaataggagaagggtcagctccgcgcgggcatcatccctaccagattgagtgttttgcacgcacttcaatcacaaaatgaaacagtgagaaagtc

SEQ ID NO: 1055 - DNA, 569 bp, Homo sapiens
gatggaggcggcgcggaggccgcggctggggttgagccgccggaggccgcgcccggcgggcgggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcggcgcccggacacgctctcccccgccagcagccccgcctctcggctcccccgccagcagccccgcctctcggctcccccgcatgcgcattaaagcagggcgggctcctgtctgtctctgtgttgtgatgaaa

SEQ ID NO: 1056 - DNA, 1544 bp, Homo sapiens
tggaggcggcgcggaggccgcggctggggttgagccgccggaggccgcgcccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggtgggttgctggagcccaggagtttgagaccagcctgggcaacatggcaagatcccatctttacatgcctgggcgtggtggcgcgtgcctgtggtcctagctactctggaggctgaagtgggaggattcccttgagccaggaattggaggctgtagtgaagtatgattgcaccactgcactccagcctgggtgacagagtaagaccctgaatcacggacagagggtactgttgggagccctggggagaaatccatgctcttggctgaagctctgagatccttgttgctgtcagggtgctgccccccgccccccggggaggggcttttgtctttgcatcgcctgcttttccagatagtctaaaaaaagacttctgaagacaaggacgttcacgaggaaaaacttgccattttgagctttttaagcagttgctgaaagcttggcagactgcctcaatttttcctaagtaggcgtcaatgaagtcaggtccaggccttggtgtgtctggaatgcttcaagcacattcgaacacttgatcgtaagggagagccggtactttggaaccggaactcacccgaggctgtggccaccgcatgggcaggctagctgggggacaagccccatatctttgggaacaagggtttgcacagccaccctgggatgccctgggactcctgaccgcacaggaccccagcagggaggccgcctggattggagggtctggtctaacagccggacttggtcttgaaccgtcgccctgtcccgcacaggcgcctgctgagcctggagccctggcagaggcgggtctggggagtggagctgccaggaggcctcccatttctcacagccttggtgttctccgggtcacccagaggaccgtcaaatgctggatttgacaaactatgtagaatgttctttgtgtctttaagatcttcttgtggtccta

SEQ ID NO: 1057 - DNA, 2028 bp, Homo sapiens
gggtctgagagtgtcagcttcctggggagaagcacggaccgcgcacctctgagctgccagggtggggacgctgccctagcgggatctgaagggattttgaaaggaatcatgtcttcagcctggaagactccccgtggatcagatgcaatgcctgagatcatggtgaaaatcattggaagtaaacactttcaatacctcgtggagaagccaaagatcaaggagaatgacagcttgaaaacagaaacccaaacaatgcaccagaaaccaatgactgataatgcaaggcagatgagcagagacaccccagttcccattaacttcactgatcagcaaaccactgataatccagatgatgtgaaagagaaaaagcacccagagaacaaccagaaatcagaaaacaaccagaaactactaacaggggcaaacagtagcagattcctggatggcaatattcccagtcaagcaaatgtccactgcagctctgtaccaaccggagaccagtccttatcctatgtgcatggcattcccaggagaaagcttagagactggtccttggaacagatggtgagaggcagctctgaccaacctgaggatattggccagagcccaagtgggacaacaaatgaagacgcttttcttcttgccctggtcagaagagaactcaagtcacgtcctttgagttccaacttattagaaaagcttcagaaagagctgaagatcctggacccaatctcttcaggatttcttctccaatctcagctgagccgcctctttttgaagcatgaagtccctctacagttaccaacagttaaaatcctttgtcagagattttctaagaggggttctcctgaaatggtgaattatgaaaagctactctggtttttaaacagtgcagcatcagattatccacagcaaaataaagcagctgcagacctgagaaaaactgagagtcatggcactcatagccaaagcactccacctcagcactccagctcacagccagaagtgaacaggagtctgttggagattttgaagatggcactaaggacaaccaatggcagactcaacatagacaatctcaatctgagttttcgaaaagaagatcgctcgttctctggctgcctccctctacctaaggtcagggctatatgtgggaagcatggattatatctgaccctgagcctgctggaaacattgcttaaccatcaagatttgggttaccaaaatgaaataaaatggcagaattttgttgagatgctgaccagagcttcttctgatttgttatctgatttgcctacagggaagaatgaaaagaaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtaacacaggagttctggagaaggaacgagccagacgcctcattcacaactacaatctcatttacaacctgtccctgagccctcagaaaatcgaccaggccttgcgcagattccgttcgggagaaaatatgctcttggagccagcactgcggtacttaaaggagctatgataacaagcccatattgtgagaacagatgtttcccttatctccctttttacccagacacatgtttctccccagcctaagtgtagtggcggaggcattgtcagagtggaggccgatgcagctattgtagatgcttttgatttggacttagtttctggctatgatgctcactcataagcagttcaaagtgatcagaggaaacctagttttatcttttgatgtggcaagaacccagctacttagaatctccttctgttttaataaaacttattattaatatta

SEQ ID NO: 1058 - DNA, 818 bp, Homo sapiens
atgtcacgtggctgttcatctgacctgaggtttcacacgtggctagggctgagaatgctgaaaaacattatagcagtagctcttctgatgctagggaagaatgaaaagaaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtaacacaggagttctggagaaggaacgagccagacgcctcattcacaactacaatctcatttacaacctgtccctgagccctcagaaaatcgaccaggccttgcgcagattccgttcgggagaaaatatgctcttggagccagcactgcggtacttaaaggagctatgataacaagcccatattgtgagaacagatgtttcccttatctccctttttacccagacacatgtttctccccagcctaagtgtagtggcggaggcattgtcagagtggaggccgatgcagctattgtagatgcttttgatttggacttagtttctggctatgatgctcactcataagcagttcaaagtgatcagaggaaacctagttttatcttttgatgtggcaagaacccagctacttagaatctccttctgttttaataaaacttattattaat

SEQ ID NO: 1059 - DNA, 786 bp, Homo sapiens
cggaccgcgcacctctgagctgccagggtggggacgctgccctagcgggatctgaagggattttgaaaggaatcatgtcttcagcctggaagactccccgtggatcagatgcaatgcctgagatcatggtgaaaatcattggaagtaaacactttcaatacctcgtggagaagccaaagatcaaggagaatgacagcttgaaaacagaaacccaaacaatgcaccagaaaccaatgactgataatgcaaggcagatgagcagagacaccccagttcccattaacttcactgatcagcaaaccactgataatccagatgatgtgaaagagaaaaagcacccagagaacaaccagaaatcagaaaacaaccagaaactactaacaggggcaaacagtagcagattcctggatggcaatgtcagggctatatgtgggaagcatggattatatctgaccctgagcctgctggaaacattgcttaaccatcaagatttgggttaccaaaatgaaataaaatggcagaattttgttgagatgctgaccagagcttcttctgatttgttatctgatttgcctacagggaagaatgaaaagaaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaaca

SEQ ID NO: 1060 - DNA, 1417 bp, Homo sapiens
tgatgaatttgtgtgtgttgtggctgatgtgcattttggtgctttgtatgcaagtttaagaatatcttagcaataggaaaggaagatttatggcagtttaattaatgaatataatgaaggctaaaacttgtagataaatttataaggtgcttaagagctcttcaatttgttaatggaaagaaacaccatttacaccggatggctacaaagcaaccttattctgagagagaggatctcattctgtcacccaggctggagtgcatgatcatagctcactgcagcctcgacctcctgggctcaagtgatcctcctgctccagcctctcaagtagctaggactacagatcttttctcagaatagcagtctgtaggctgtcacctaaagtgtcctgttttcagtgctgcacctgctctgagcttcatctttttacgaagacgtcatggtgtgctatctgtactgggaaactttccccagcatcagccatctcctgaagataacattgtctgctagagattgtcatgtatgtggattgaatctctttatcttcatggatccagttgaaaatcaggcattgcatccagttatcatggctttaatcttaatgccttccctgcactgttttgggaatatcttaatactgctatttttgaagagtccagctcagttattctgcagaatgtctgttgatttggctttgctgtttcctcataagtagatccagattatacgtttttgttgatgttgggttcttctcagtgaatcacatccgatgatgtcagcacgaggcctgatcatttggtttaggtagctttcactagactttttcattgtaaaggtacctatcccttttctaattaataagtaatatgttgggtgatagtttgtgtgtgaatatccttttctccagtgacctttcatccaatggtttcagcattttaaatgatcctgggctgagtcagttttcagtggtggctgcagacttgtggttttccaattctttcatcacttttacatttattaattggcagtctatgacttcttatagccacataaagataattcaggaattatctgaacctatgaatgttaccttatttggaaaaagagtctttgcagatacaattcaattaagaatcttgagatgaggagattatcctggattatccaatgggccctaaatccaatgacaaatgtccttggcagagggagatttgagacaggagaagagaagacacgaaggagggaaggaagtgatgtgaccacagaggcagcgattggagtgatgtagtcacaagccaaggagcaccaacagccaccaggagctggaagagcccaagagtatatactaatacctggatttgggacttgggacttctggtctctagaagtaggaaagaataaacatctgttttttgtt

SEQ ID NO: 1061 - DNA, 759 bp, Homo sapiens
caagatggtctagcttgagctctgtaggcttgactgatgaaataagtagtagttttttgctaaaataaccacattgtttgcaaaagttttctcctttgagttttctagggtcattacaatgatctaactgccttacctgcttttgaactggttgagcctcttgtgggaccgaaaacaaaagaagggtgttgaaatgcaaatagataactctgggtcccagtccctgactgcaaaaggaagccaaaactgacaacaacgtctccttctctacggaggtttgtagaaaggctgtacaaaaatctcacaagatgtatttcttctcgtggactggagtcccaaggtgcttaagagctcttcaatttgttaatggaaagaaacaccatttacaccggatggctacaaagcaaccttattctggatccagttgaaaatcaggcattgcatccagttatcatggctttaatcttaatgccttccctgcactgttttgggaatatcttaatactgctatttttgaagagtccagctcagttattctgcagaatagggagatttgagacaggagaagagaagacacgaaggagggaaggaagtgatgtgaccacagaggcagcgattggagtgatgtagtcacaagccaaggagcaccaacagccaccaggagctggaagagcccaagagtatatactaatacctggatttgggacttgggacttctggtctctagaagtaggaaagaataaacatctgttttttgtt

SEQ ID NO: 1062 - DNA, 3037 bp, Homo sapiens
atgccgggcggagatacgaccccggaggaagcagccgctcccagctgcgccgggtacaacccaggactgcttctttttcgcgcccaaaaagcccagggcgcctgcgtcacaagcactgaaggggcgtggccacgccgcgcatccgcgctttacggcggccgcaaaatgaggtgtggcgagtcaggcgcgggcccggatccaagatcaaactcagctgaagtcagttcctctcaacctgccctggcatcaaagtctcaaagcaagtgggggccaaccagcaacaaccccaggggagctttgacaaccacagaatttgagatggctggtaatcgttctcagaacataaaacacaaacagacagccctgattgctattccaatgtcatcacaaacccccaggatgcttggaaggccaaggaatcaaggtcagctgtatccacagccctagtctcaagccttcatcctcttacccgatagcaggcgattcccagtcctagccagatagatgagccccagtctcaggaagatgaagtgcatctcagaagcatccactacaaagctaatggttcgttcatagcatgccttggcctcagaatgatttccactcagaaaatagagatggcccttcaggccccagacattggggttctgggaaagtgaaaagcaagtagtatatgggataaggtagtatttaaaagtaccttgatgatctttgtttaacatttaaatttagatagattgtccatttcctttctcttttctttttcagatcaaccgttttctttttctaagagcactcagaaacataaccatttaattgtacaaggagacatttttctagctctgccctcagatttctttcttgcattcttcaaagccattttgggtgtggagtaaatattaagaaaaacattcaagcataaccccaatactgttcacatgagaaaatataagaaatctagaaaaattgaaataaacactatcagctaaagatatccttttctctgctctttgcaaaactcatgattactttattattattattttttgagatggagtcttgcactgtcgcccaggctggagagtgcaatggctcaatctccgctcactgcaacctccgcctcccaggttcaggcgagtctcctgcctcaccctcctgagtagctgggattacaggcacctgccaccacgcccatctaattttttgtatttttagtagagatggggtttcactatgttggccaggctggtcttgaactcctgacctcgtgatctgcctgcctcggcctcccaaagtgctgcgattacagttgtgagccaccgcgcccagccaactcatgattacttaagaaaagcaaatggaagggtatagagagatgagtttactgacagctgatgaccacccttctgttcaccagaaatctacgtgtgatatggcatcaccacctttaaataaagccccttctccagactcaagaggctttagcaaaagtcattaccaggtagtccatctgggctgcttgttgaaggtattcctctgccttggcaaagttcttcttaagaatgtgtgtttgggccagcaccaagtaatattcacagctggggcctccttgagggcataacagctcatgtgcaagcactctgtgcacatactgcaaggataatcagattataagcaacatataaatggctgcattgcgtctttttcggttgaaggattctgtctctgataataaataatacgaaatgtattacagaatgaaataattatcctcaacttcaaaaggtaaagggtgaattacaaacattctgcacttcatagttccattaccagctattcacctagtcaccaaatgaagacattaccaagtgaataacttgcaatattgtacaattctggtcttgctggtcatcatactaggtgagtgttagactgcatgtattatgcagcagacaaaggcacatcatcaaccaccccatttacaaaggaggtaacattttcaggcagctgacattgtaaggaaacttaagtgaggtaaaactgcctttctaacaatctagacttgaaatcttagaaacataaatgtctgttttggatccacctccaaacattggttatgtttaccagttttgtagtttgggtcaatttttgtattttgtttttttttttttctttttttagagacagggtcttactctgtcacccagggctgcttactgcagccttctggcctcaagcaatcctcctgccttggcttcccaaaagtgctggaattataggggtgagccccatgcctggccaaatctttgctttttacactttataagacctacaaaattaacaaagttagatatacttcttaagtcgagggtaaatccttcttttcatctcccactgttcccatctcagcctataatgtagaaaattctacattatacttacacctttttaggagaatactagagggaacagctgcagctattttttccacctgccttctgggtctctgacctgggggagctaatgacttatttagctgtggaagaagagagtctgtttctattttgcggagggttaatgtgttaaagcctcctgcttaatgtggctcaatcccacccagttaataattcttgccctttcttgagcttgcctgcccttgagtagggcatgcacttggcaggatcaaaaccaaacactcctggctcctgagtcttgatctctcctactgcttgctcatgaatatgcttctttcttcccatgtaataggcagacttcctagaatgctcttcttctctgagaggaggcttcaattcttcagctgctctacctgtgactgcatgggtaagtcaaatgtggggctagttatgttgtccagccaagttttaccaataaaaataagctaatatttttattcccccacatagtactgtgtatgtttctagttggatctaacctagaagggaagaagggaatgatttggctcctgtgaacccccaacactcacaaaatgaattcccataataaagtgatatcaggc

SEQ ID NO: 1063 - DNA, 1685 bp, Homo sapiens
gagattgcggcgatgtcgcaggggacgactccctgggggccgaccccggcgggaaccacgcccgaatcggaggtacaccgcccctttcccttcccggtaccggtgccggtaccagagacctccgagcgctcattcccagtccgcggagtctgcggccaagccaaatccggtctccgaagaggcgccgcacgtctggccccggctgaaaactgagaatatttttgaatttcaaaaaccttgaaacttgtttaaaggatgccattctactagattattatgtatctggatttttgtgggctagaggaatggatttctctattattcagtattcaaaatttatgactttactagctatgtcacttcaaaatcttaaaacactacatatgtccttagaggaaagcataaaatggcttggagaagttatggctgaaataggaccaacacattcgcaaaagagtgaggactggaatatctttgatgtaaaacaagccaatgctatcattgattacttaaaaatcagcttatttcaacactacaagctatacgagtttatgttctactctgccagggaagaaattgtgataggaactgagcaagtgatagaggttgtcaagtctgcatgtggccctttcccaaatcctctggaagaaggaatctcatttgatatttattcaacattcatagagccccccacaatattggatacggaaatgaagaggttggatcaagaacaaggccctgaggagtctcagccagaaactgacacctcagacatggatcctttagttggttttaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaagtaattagaaaagtattggtcccaattttgctatctcccatcccataacagcctctgaatttattgcaccaagtgtaatgagaacattttgtatacaagagtttgaaaaattatatataaaaatacaattacttttatgatagtcctttgacgttttgactaataaatcctattcatcttcaaggagaatgaagtcaactttttaaataaccagaaataaagaaagatgataataacttcatccattttgacccaaacggactgccacgttactggaacactgtgaaaacataccagtaccacactattgaggataaaatttgttaaacaatagcaattcaaatgcatatatgaggttttttttttttttactgaaatcatttggttttcttatttaaacgtttcagtgtgaaaccaattttctgaaattatataatgcagtttgaagcactttaatttattctgtactgtatttgttatttctaatcttgttactctcccaggagaatacatgacctatataaaaagaagcaatgtataaatggttattaaagaccaacctatatatagattgtaaaaatcttaaatacaaatcaaactcatagagttcccagaa

SEQ ID NO: 1064 - DNA, 253 bp, Homo sapiens
gggccgaccccggcgggaaccacgcccgaatcggagcactacatatgtccttagaggaaagcataaaatggcttggagaagttatggctgaaataggaccaacacattcgcaaaagagtgaggactggaatatctttgatgtaaaacaagccaatgctatcattgattacttaaaaatcagcttatttcaacactacaagctatacgagtttatgttctactctgccagggaagaaattgtgataggaactga

SEQ ID NO: 1065 - DNA, 1676 bp, Homo sapiens
aggagagaaaatagcttgacacctcctgcggcccatggagtcctcccgttgggacaaggaccccccaggagagagaagaccccagcagagtcaacactggaggtcctgcggggtgggtggtgctggggaggccacacggggagggctgttccctgttcccttcccctcaggagacagctggcccgaggtgacacagcactggatgcgatttcagggccagggaccatggtgcccggggctgtggaccacgccagcccacagccactgcaagccccagaccggggctgtggataacgccagcccacggcagccacacgccccagaccaacacgagaagaacgcaggccgacaacatcttcatctatggagcctggcctgtcccccgtggctccacagcataccgcacatcaaaggcacgattctctccgaagccctcagtggcttcctagtatctgacagaagaaccaaaactgtggcaggcctgcgatggctgtggttgaggaaagaggccacacccacagccagcagaaccacactcagcagcagcctagccccacgtggaagaggcgtgaacactctcgggagaggtggatgtacgctaatggttctcagctccgacctctgtgattaacagaacatgctgattggttttatctgaacgtcacacaaaagggtttctatgtccaggaaagactctaaacactctggaccctgctggggcagatggtgaccgtgacccagtgataccactctccagtgggcagcctggtctgcagagggggagatccctggggcagccctacctcagcatgggtgagtttctgttgcaattctatgtccagtgtaaataaactgtggaaaactgggagatggtacaagaaagcaaggatgccaactaaatgaatagaaagatctacaagggaaggctgagatcagctgaaataggattgggaaagtaaaggcctggctggaacttcgtaatggcttttgaggctcgggaacagggacagtagctgccctgtccatcccaggagagaacagacggacatggctggaaagcacttccctgactaaaagtgtctttaaaaagggagatctcagaatctccttccctggaatgctttaacccttcatggaacacagcagaaattccacagccctgcatcccaggaagcagggacaggacagcagcttccagcacacagaagcatttagaggcataagtagctacgcaaagacagcaggagccgtgcctcgaaaaggctgagatgtctgagaaataaagttgtacgcggatttacgcctgggcaggttgaaatgcgtgtgccatgacagatccggaagcttgtctactcgaaggtccacatccaggtatgtttcacagtcatcacaactagattttcagaaatttaaaactcctaatgaagaaacacaaacctgcacgtctcacgccaccacttaaggcagcggctctcaagcaggggcgattctactgggaggagggatgctgatggcaccagagggtgggaagcagggatctgacgcttagcaccgcaggtgccaaggacggcctcctccccacaagggctccgggaggccacaccagagggtgggaggcaggggtgacgctcagcactgcaggcaccgaggacagcctcctcccaggaggaaaaaac

SEQ ID NO: 1066 - DNA, 2249 bp, Homo sapiens
aacacatcaaaacggaaaaggaaatgtaagcagtgtttgccgtccaaagttcacatcaacaattccttattaggaaggcaattctgagcctttcctcctgcatctgggagctgccagcaacccagttccaggagagaaaatagcttgacacctcctgcggcccatggagtcctcccgttgggacaaggaccccccaggagagagaagaccccagcagagtcaacactggagggccagggaccatggtgcccggggctgtggaccacgccagcccacagccactgcaagccccagaccggggctgtggataacgccagcccacggcagccacacgccccagaccaacacgagaagaacgcaggccgacaacatcttcatctatgaatcctggctgatccaccatggaacccagatgtcctcagttctgcctcagcccccacttgtgagaggtccgtggcataacacaaactccccctgggattcgtgggcctcacgggggaagctgagggtgtgtccatgcaggaccccgaggctacacagctctggctgtttctcttccaaagccggcactgccctctctccatctctcccggtgccagggctcaggccccagcccccgtttctgcagaagcccctttccatcctagcccctgccacccctcctgctcttgtctctcccacacctcccaaactctctcctggccagctctcgccacactcagtcaatgtccactgggggcctcaggggcacctccacctgcccaggtctgggaccaccgtcctccacgcatatctacagaccctgtcctcacctgcatcacaccaatgatggcgtcacagcgtgggttccggtcaccagtcggcctcccccaccaacgtggactccttacaagcagagccaccaacgtggacacgatcccatcaggaaccacctacttttgcatccccagcactgtgctcaggtcccagggaggccccagcaaactgtggaacaaccaaactcgtgactgaatgaacaagtatgttaagtcgttaagtaaaaatagcagaagacttagtagaatgtatgagtaacaattacaattatatgaaaatccgtatccacgtgaaggtattatgcaaaaaaagcttaactttgtttcagtgcctttccagttaaatgttgttaagcagtatttcccccaaaaggtgcatcttttataaaacaagaacgcaaggctctgaggccaactttgaacatttatttgagtgaattcacgtcccccaaattttccgtatcccaaaatctggacttttgctaaatggtgcccttagcacaggagtctctccaaggaagtggcctgagctgagagggggcctggcatcgcccacccaggtcatcagtcatcatcagcagcagctgcggcatgagagagatggtgtggggcgaaaccaatggggaaactacaaaagaaaccacctgctactgcaaacggcctcgctgtactcagggagtcggttccaggaccccatggacaccaaatccaggcacactcacgccccacaagtggacctgccgaacctgcgtgtacagagtcggccctccgacacacgtttcacatggcaggaacactgtattttctccctgagtttggttgaaaaaattcacatataagttgacccacaaagctcaagcttgtgtggtacaagagtcaactgtatgcaattgacactgattcctaccaacgatatccaaatcttagcatgagcagcacgataaacagaatgagcaaaattcaaaaactaaagcagcgtttttcctgcaagtgggcgcactgcgtatcccctgcgggaaagaccacgctggctgctgaccaaactccactggcatcttcctccatcctgagggcatcttcctcggcatcttcctccatcgacagcagcctgggctcacctcccagcccgaggctgagaactgagttccagtcccggggtggggtggcgggggggcgcactgtgcaccctcccagctctcctccaccccttccctcaggctggcccaagaatagcctggacaatcacctgctggggacaccgggctgcccctcctccgcccacagcctcaggccacctgtctcatccgtgaccgagaaacggagctgcagtgggaggcgggacatgctgggatctacccatggccaggccaagctgcgccaatcactcaagcttcactttgatcacttgctctaccaaataaaacagaacaaaat

SEQ ID NO: 1067 - DNA, 996 bp, Homo sapiens
cggggtcaggccgccgtcggggcgcggggcgctgcgggccacctgttgcagcgggcggccagggctcacctgcgcggagaccgggccgaggggcggcggcggcgagcggcggagctgaggtccccgaggctagcccgcgcctccggcttccgccgggtcagctgactgcccagtgcggaactgtgcgcccgccgcgctcccctgccgcgctccccgctgctgccgccgcgcccccgcgctccgtcccgcgcgcccgcagcgtcctggccgccatggccgggctcgtggtgcgtggaactcaagtgtcctacataggccaggactgcagagaaattccagagcaccttggcagggactgtggacatttcgcaaagaggcttgatctgagctttaaccttctgaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaat

SEQ ID NO: 1068 - DNA, 899 bp, Homo sapiens
gttgaagaaagaggatctggctgaaagacccgcaactttcacttgttgagaacctttagccagcgccggcgtgcatgtgttttagttttattctttttcccttgcccccaaagccgtggagtacctgctgttgctctcatgcctcttgccaacagtggcatctgctcagtgtagccatcaagaatttgaatgtcaatatctttgccttgaaatgaatggaaaagtatttgtcactcagcggcaatcattcttcaaataaaaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaacaa

SEQ ID NO: 1069 - DNA, 578 bp, Homo sapiens
atgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggcctggtaaggcagaacggagagccgagaagggcctgaggcctcccaggaagctggttggggagaccagaaggctgcaaagctggccaacgcttgccaggtggctgcggagagtcagcttcagtctctacaagccgcccatccaggcagctcctgaaccagatccaggcaactgggccaagtccccaaggctgtctctgggaccagaaggtataaccaaagggaagcatggatttaaattccagggcataaaagaaaagttcaacgtatctaagaaggtgctgaaaatgacttttttgtaaatgtctgaaggacactgtcttataccataccatatacaataaaattttaaatgagcctg

SEQ ID NO: 1070 - DNA, 614 bp, Homo sapiens
atgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggcttgaagaacggacagctgcactttatcccataggcctggtaaggcagaacggagagccgagaagggcctgaggcctcccaggaagctggttggggagaccagaaggctgcaaagctggccaacgcttgccaggtggctgcggagagtcagcttcagtctctacaagccgcccatccaggcagctcctgaaccagatccaggcaactgggccaagtccccaaggctgtctctgggaccagaaggtataaccaaagggaagcatggatttaaattccagggcataaaagaaaagttcaacgtatctaagaaggtgctgaaaatgacttttttgtaaatgtctgaaggacactgtcttataccataccatatacaataaaattttaaatgagcctga

SEQ ID NO: 1071 - DNA, 579 bp, Homo sapiens
atgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggcctggtaaggcagaacggagagccgagaagggcctgaggcctcccaggaagctggttggggagaccagaaggctgcaaagctggccaacgcttgccaggtggctgcggagagtcagcttcagtctctacaagccgcccatccaggcagctcctgaaccagatccaggcaactgggccaagtccccaaggctgtctctgggaccagaaggtataaccaaagggaagcatggatttaaattccagggcataaaagaaaagttcaacgtatctaagaaggtgctgaaaatgacttttttgtaaatgtctgaaggacactgtcttataccataccatatacaataaaattttaaatgagcctga

SEQ ID NO: 1072 - DNA, 1967 bp, Homo sapiens
ccattgaggaccagggtcgcgccgagaggccggagggggctccaggcagcctggagctgacggcgccgggctgcgtcctcttcacctgggggtggggggtgggggcacgtactttgtgaccaggatggtgccgagccccctctacggcgggagcttgcaggggtgcgggggtgtgactggcgctccgcggactcgtgtccacagtacagaggacatgtagggttcggccggggcgcggctgcaccggggcctgcctcgcggacctggactcgggactccgggcggccctgcctggtgccattgcctcagccaagtctcccacctctctgctcggtttcccgccccacctttcccctactaccgcatccctgtcccctcgcttccctccgcgatgtctccatccgagtaagaaacgaagctgaacgcattggtaactgtgctcaagaagatgcaatcgcgggagccctcagggtggcgcacggcggagaggcgacgcgggtggcgctgcagaggcgtccccaccccctccggggaccggggccccggagctgccaggcccgctgcacgcggcggcgcgggagaaaccacggggcagcagcgccccctgcaggtgccgggcgcctccgcagccgctgcgcggacccgactcttaaggtggcaccaccgggttcccagcccgcgcgcaacccgcagccctggctccatccgccgcacttctccctgtagcggcgggcctgaccgtccggaacggccggagtgtgctgatgcctgctgctatctgcttgatcccttcaccctacctctcatccaggacttcttccgcggatgcgcagctagcgatttcgacaggcgagattgaaaattccgggcgagtatatgaggttgagtaagtcccgcttcagggaggaacgaccagaatgacatttctttaagcctaaatcaaacttttattttcgtttataaaaagcagaaggccagcaggaaagggtcgcggaggactggcacatccacaaccgtaggactcttggatccaagtttttaggctgagactgggcggtccggggttctccttcggcgctcacaccccgcaaactcgtgggcagtgcagtgctggaggccgggggcagtggcggacccgcagggtaaccttgtctcgcgcacctcccgagcccccagcagcccactctcgtccgaatgctttgtttatttggtgacaccagggaacgtggagaagaagatcgaagttcagtttttcttttttctttattttaaatatttttcttaactaaatggtatgtttatgtgaacccatcatctcttggaattaagtgtcctcagcgaactccagattcctaggggaaacctacgtgcccagagcaggaaacgcacaagtcaattcaggttccggtgccatccgcagtaaattcccttccttttgctccaaattcctcctctgcgtccaggagagggacccccgggactcccgcacacccaggaccgggagcggcagagcagagggcgggtgcgagggcgcgagggaagggaggcggcctgcggacctggggcgcgcagtttcccggctccgtgggaacctccaaccccggggcgcgcggcctaggctccgccctgccaggcttggggccgagcggcccacctagtgggtcctgacctggggaagccgagtccgcgcgcgggtcgggccgcgacgagggaagctcgcctgggcaagtgccgcgcggggtcagacccaccccaggggttgcaaaccgcaagcgaaagtcgagaggggctggagctttccctctgatccgttttacactgtgaaaaccgcaggcctgtcgcctaggcggccacttttaaattgggaagcaaatagacgaaaaaccaaaacaaacgtacgagctgacttttcccagctaagtttcccctcaataaaaagcccgctttctgggaaagacagaaactga

SEQ ID NO: 1073 - DNA, 640 bp, Homo sapiens
atgtttacaaggcacacactgtttcgtcagtttgcagtgcttgctgacacatccttcaattatattaaagtaaaacccttattagtgcagtctagaacgaccatgacagctatatcctcttcaagtcattgtacatcttcaatagacggtaagcatgtggatgtagtcagtgatcaggcagcccttcaactttcaccaaaagggaagttgtcggaatccccaaaagaagagtccttggaggagccctccatgcgccagagcagccccgcagagactgttgattaacccagcagaagcctgggctgcgcagacggggcctcagaaagagtggcctcgccgtcctggtgtaaggtgcctccctcggaaaggatactatctccaaggattttctaaactaattgtttaatctctccagattatgtatattaaccagcactgcgctcgaatagacctcaatgcgcgccttgtgcgcgctcctttccacgcctttaaggaaagccctggctggtgctgggtgagcggggcgcactgaacctccggggcaaccacatccattcaggagctccggggactcagaagagcccaggcgtctaagagtgggaagggacggactttaattaaaaagtttgactccctctct

SEQ ID NO: 1074 - DNA, 800 bp, Homo sapiens
aacatggtttggagtctcaaatagaagcattaaaggcaaatttagagaatgagaaaaagaaggtggaaaggtttaggaaggaagctgatcgactaaataaaagctgggaaaagagattctttattctcaggaacagctttcatgtccttaagaatgagatgtttacaaggcacacactgtttcgtcagtttgcagtgcttgctgacacatccttcaattatattaaagtaaaacccttattagtgcagtctagaacgaccatgacagctatatcctcttcaagtcattgtacatcttcaatagacggtaagcatgtggatgtagtcagtgatcaggcagcccttcaactttcaccaaaagggaagttgtcggaatccccaaaagaagagtccttggaggagccctccatgcgccagagcagccccgcagagactgttgattaacccagcagaagcctgggctgcgcagacggggcctcagaaagagtggcctcgccgtcctggtgtaaggtgcctccctcggaaaggatactatctccaaggattttctaaactaattgtttaatctctccagattatgtatattaaccagcactgcgctcgaatagacctcaatgcgcgccttgtgcgcgctcctttccacgcctttaaggaaagccctggctggtgctgggtgagcggggcgcactgaacctccggggcaaccacatccattcaggagctccggggactcagaagagcccaggcgtctaagagtgggaagggacggactttaattaaaaagtttgactccctctctaa

SEQ ID NO: 1075 - DNA, 361 bp, Homo sapiens
cgtcgctccagctgctcttgacgactccacagataccccgaagccatggcaagcaagggcttgcaggacctgaagcaacaggtggaggggaccgcccaggaagccgccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttccc

SEQ ID NO: 1076 - DNA, 917 bp, Homo sapiens
aaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagcccccatctcg

SEQ ID NO: 1077 - DNA, 229 bp, Homo sapiens
aggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgccatggaccagctggccaagaccacccaggaaaccatcgacaagactgctaacca

SEQ ID NO: 1078 - DNA, 2035 bp, Homo sapiens
tctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggaggaaaaagtcctggatttcgagtcagaacatctggattagaatcctacttctttcacttgataatcttgttacctgtggaaatcagaagagagaatatagtaaaaatacgcagtacagtcccagatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagtaagttttttatacctttaggttattttttttccctcacaggcacagggattcgagataaaattctttaaaggaaaataccattttgttcatttttacttgcacattagaatcatgcacatagtagttgaacaataaatgtatagttgctgaatgtgtgagcaaatgtcgagtttttcagatatctgagttcaatatgttaaatagtgtaaatgtattaacgtgctagaaatttttatagacaactcaaaatttttcacttttgaaagaatgtagaagtatattgtcaaaactaagagaaactcaaaaggaaataacaagtcataaaattccacaactttttcttaaaatctgcattctaaattcattggtttaaaacattaaaatttagagaacagaataattgattatcgttcagtaaataataatacagttttggatatgtgaagttctgttttcatgatagtttaaaatttaccatcttaaccatttttatgtgtacgtttcagtagtgttattatatattcacactgttggacaaccaatctgcagaactttttcactttgcaaatctgaaacactgtattcgttaaacaacactatttccacttgccctcagtccctggcaaccaccattctactttctgttgctgagtttgactactcatgatacctcatgtaggtgaaatcatatacttttcatttcatgactggcttatttcatttagcctaatgtcctcatttatccatgttgtaacatgtcagaatttcatttctttttaaggctcaataatattgcattgtatgtatataccacattttgtttattcatccattaatggacatctgggttccttctgctttttggctgttgttaataatgctactgtgaacttgggtttgcaagtatctcttcaagactccaaggcccttcttgatattacccccaaacaaatgcctgctgttgctattcatatccttactgtaatactatattatgtgaataaactgtatgcttttgtacttgaa

SEQ ID NO: 1079 - DNA, 1928 bp, Homo sapiens
gcttcagtgtcgccgccatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagtaagttttttatacctttaggttattttttttccctcacaggcacagggattcgagataaaattctttaaaggaaaataccattttgttcatttttacttgcacattagaatcatgcacatagtagttgaacaataaatgtatagttgctgaatgtgtgagcaaatgtcgagtttttcagatatctgagttcaatatgttaaatagtgtaaatgtattaacgtgctagaaatttttatagacaactcaaaatttttcacttttgaaagaatgtagaagtatattgtcaaaactaagagaaactcaaaaggaaataacaagtcataaaattccacaactttttcttaaaatctgcattctaaattcattggtttaaaacattaaaatttagagaacagaataattgattatcgttcagtaaataataatacagttttggatatgtgaagttctgttttcatgatagtttaaaatttaccatcttaaccatttttatgtgtacgtttcagtagtgttattatatattcacactgttggacaaccaatctgcagaactttttcactttgcaaatctgaaacactgtattcgttaaacaacactatttccacttgccctcagtccctggcaaccaccattctactttctgttgctgagtttgactactcatgatacctcatgtaggtgaaatcatatacttttcatttcatgactggcttatttcatttagcctaatgtcctcatttatccatgttgtaacatgtcagaatttcatttctttttaaggctcaataatattgcattgtatgtatataccacattttgtttattcatccattaatggacatctgggttccttctgctttttggctgttgttaataatgctactgtgaacttgggtttgcaagtatctcttcaagactccaaggcccttcttgatattacccccaaacaaatgcctgctgttgctattcatatccttactgtaatactatattatgtgaataaactgtatgcttttgtacttgaa

SEQ ID NO: 1080 - DNA, 7245 bp, Homo sapiens
gcttcagtgtcgccgccatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagttaattaaagaaaataagaagcatcaggagctcttcgtagacatttgttcagaaaaagacaatttaagagaagaactaaagaaaagaacagaaactgagaagcagcatatgaacacaattaaacagttagaatcaagaatagaagaacttaataaagaagttaaagcttccagagatcaactaatagctcaagacgttacagctaaaaatgcagttcagcagttacacaaagagatggcccaacggatggaacaggccaacaagaaatgtgaagaggcacgccaagaaaaagaagcaatggtaatgaaatatgtaagaggtgagaaggaatctttagatcttcgaaaggaaaaagagacacttgagaaaaaacttagagatgcaaataaggaacttgagaaaaacactaacaaaattaagcagctttctcaggagaaaggacggttgcaccagctgtatgaaactaaggaaggcgaaacgactagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaatgagcttgatgcaaagcttagagtcacaaaaggagaacttgaaaaacaaatgcaagaaaaatctgaccagctagagatgcatcatgccaaaataaaggaactagaagatctgaagagaacatttaaggagggtatggatgagttaagaacactgagaacaaaggtgaaatgtctagaagatgaacgattaagaacagaagatgaattatcaaaatataaggaaattattaatcgccaaaaagctgaaattcagaatttattggacaaggtgaaaactgcagatcagctacaggagcagcttcaaagaggtaagcaagaaattgaaaatttgaaagaagaagtggaaagtcttaattctttgattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtgaacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacgaagaaaattagatcaggttgagagtggaagctatgacaaagaagtcagcagcatgggaagtcgttctagttcatcagggtccctgaatgctcgaagcagtgcagaagatcgatctccagaaaatactgggtcctcagtagctgtggataactttccacaagtagataaggccatgttgattgagagaatagttaggctgcaaaaagcacatgcccggaaaaatgaaaagatagaatttatggaggaccacatcaaacaactggtggaagaaattaggaaaaaaacaaaaataattcaaagttatattttacgagaagaatcaggcacactttcttcagaggcatctgattttaacaaagttcatttaagtagacggggtggcatcatggcatctttatatacatcccatccagctgacaatggattaacattggagctctctttggaaatcaaccgaaaattacaggctgttttggaggatacgttactaaaaaatattactttgaaggaaaatctacaaacacttggaacagaaatagaacgtcttattaaacaccagcatgaactagaacagaggacaaagaaaacctaaaacaagcctcttgctcagtaaagagacaaaagccacacaggagtaggtgccactgacctctattgttggagactttgttccactttttgtttcagccagtaaaaatattgttttgcttcatctgtacacaaaaaaatacccttttacaatatgaatgcattgctgtatatactgtaagactgaaagctttgatgaaatttgtttttgtatggtgcaatatgacagcctgtcattgaatctaaacaacttaatttgcttgtattcataagaagtgttgaacattacaagggcttttataaaaaaccctttgttcatatttcttccctttaaaatatgtaatgtcaaaaatgactcaccttttaaaaattatgcatgaaaacaggtggtaaacattcagtaatacgctatttctccaacatcaagacaactaaaacaaatgataaaaatgtttatttttacactccagcatatcgggtgagttttagggatgtgtatgaatatttaaatcttttaatttcagttttaatgaaagctgaacttaataggaaagctagctcttggtaactagcaatgatcaggcattgtttgcctctgtcaggttttcttatctgttttaggtacattttttcagattctgattgtttgagttaatggttgaatttttaaagtttttagttacttaaaatatgattttaaattacatattaatttagaaaattcctgtgtttacttatattttaaattgtgaaatggatccaatcattagaacagagagaatagttctttgaaactgaaatactttagttttactgaccttgtgtaaagataatatgaagaaccagcttccaaaagaaaccagcatatggcactataaactatttcatttgagcaccattctttaccatggatatattaattatgtattatagtggagtgatcatacagttcccccaaatgtgatgtttcagtgtatttatttaaaacataaagtagaccaggtgcagtagctcacgcctgtaatcccagcactttgggaagccaaggcaggaggattacctgaggccaggagtttaagaccagccttggcaacatagcgagacccccatctctacaaagaaattttaaaagattatccaggcatggtggtgcatgcctatggttccagctactcgggaggctgaagcggtagaatcacttgagcacaggaggtcaaggctgcaggtgagccatgatcgtgtcactgcactccagcctaggcaacagagcaagaccctgtctcttaaaacaaaaaacctcacacatacctaaaataagtatatatctgtaaccaaaggaacttaattttagagccaaatttttctatcttgttggattttttacagtgtttaagatagacacttaagtgttgccgtagtatcaatatttctgtcattgaattttttctcaccccttattatttctcacttacaatttctgagcatgatttttcataattcattatcttcagatcattactataataagataccgtggctcttatgcagatattgcagcaagccttgtttggtttggatttttgcatccctttttctcccattaagggaattaagttttgggatgatggattaaaagcctgtaaagaattgtttgggctctaaaagttgggctcatggtggcaatatccttttaatgtgttttaacattttttaatcaacatcgtttaaaaataatttactaaggattagattatttaatgaatgtctttttttctatatattgaattagatgttatcccaaaaaaaatatcttttcacttcaaaatgaaaatatatgttcaaagatgttttatttttagaatagttataaaaagtattagtcttaacataatgtgtcttgttctttttaccaataataatttatcaaaataagagggaaagtgcaatcaaatctgaattattttactatttgtttctagacacactacttaacactcctaaagactactttgagtaggcaacataactaaatttttctagtttcttatgatacaggttcataaactacaatatttggatttttttccccaaggcacaaaatgtataatggagaccaaatagtgatctgatccatagtatcctatgcctatacactttaaaatgtatatacattttagacaaaaatgcacactccagtattaatatttgtgctaccatctacttggagaagtttaatgagaaaattttagaagaaaagtattacaaacaatattttgactctattacctgttttgccttatacattttagaaactggaaattttttaaagaaaatgctttagttttcttctgttcttcactgtctacagtgtgcttttgtatatggatcaggactgagcaaagtaattacatgtatcagagatacttatctctatactaattcacagacagctcctgatgtaaggatttagagggccttctgccctctgaatatatggtgaggagaatggggtatctggaaaaggaaaatgatctggataaatctgagacctggggggaagtttgttttatatgttcattattggttgttacatatcaaggctgttttggttatgtatcaatattgtggtttatttgagctggaagtgattttttctgtgtatgtatatgtatacacttcaataggttttaattttgaagtgaatatttgccatgactccattttccccataccacttcagactttagcctgtttagttttaaggactgaaaatggtaggtttgggcagaagaatgaatttgaactttgatggggtttttttgtttttactttctatcttcataaccatttaaagcgatttagcttgaaattaaattttatcaggctaccaacatgttatttatttatttaataaacacatttattgaaaacctatactattgtattggcaccatacagggtattgtatttatactagtgagcagaccagggcatttccatcctcatggagttcatggtctaatgaaaatagctggggccgggtgtggtggctcacccctgtaatcccagcactttgggaggctgaggtgggaggattgtttgagcccaggagtttgagaccagccagggcaacatggcaaaaccccatgtgtacaaaagattaaaaaattagccagatgcagtggcacatggctggggtcccagctacccaggaggctgagttgggaggatcatctgagcctgggaggttgaagcttgcagtgagctatgattgccactgtactctatactccagcctgggtgacagagtgaaaccctgtctcaaaaaaaaaagaggaaagaaaatagctaggagacaatcagagcagatcttgggcttctgtggctcatctcagccctttataactggcctgagaagagggtttatctacttgtgcaagtggcccagaaatctcactcgtacatgaggctttggaacatccttgcaaaggtacgctgaaagcaaattgctgttttcctggtggttctgcacgtttcctaacttttatcatagtttgattttcattatttaagaaaaaataaaaaatccaaagaccataagatggcattagattttttaccattaaattattaatgcctatttggtgctcataaagattaatcatgtcacgcatgtttccaatctttcttttgcagtatattattttctaaaaattgttacatgcaaatttaaaccaagatttatcagtaaaagaaaaaaatagaatccttaataatgtaaatgttgttatatatgctaccctggtgaaaatatttttataaatcatgttgtcatttatgctttatgtagcctatttttcaataacctttttttaaaagcaattttttttgacaccaagattgttgatttttaattaacaccagttggtggcactagaaacctgaaatttttcaaagatgaacaaagaaaaattgaaaaggtaatctaaacatggagaatttttaggaaaataaatgaaaaatataattgtatattagagatgtatttttcttctggaatggaattctttttctaaaatgcaaatcgctatccattttgactgcaatgatgaaacttgtttatcttccagaggacatatatatatgtgtgtgtgtgtgtattgtacagatacctttaatttgattacactgtttcttgtaaatatgtttctgtataaaatgaaacttttcaagaggattctatgtatatattgtacttattaaataggtaatgcctatttaccaa

SEQ ID NO: 1081 - DNA, 1576 bp, Homo sapiens
tagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaatgagcttgatgcaaagcttagagtcacaaaaggagaacttgaaaaacaaatgcaagaaaaatctgaccagctagagatgcatcatgccaaaataaaggaactagaagatctgaagagaacatttaaggagggtatggatgagttaagaacactgagaacaaaggtgaaatgtctagaagatgaacgattaagaacagaagatgaattatcaaaatataaggaaattattaatcgccaaaaagctgaaattcagaatttattggacaaggtgaaaactgcagatcagctacaggagcagcttcaaagaggtaagcaagaaattgaaaatttgaaagaagaagtggaaagtcttaattctttgattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtgaacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacgaagaaaattagatcaggttgagagtggaagctatgacaaagaagtcagcagcatgggaagtcgttctagttcatcagggtccctgaatgctcgaagcagtgcagaagatcgatctccagaaaatactgggtcctcagtagctgtggataactttccacaagtagataaggccatgttgattgagagaatagttaggctgcaaaaagcacatgcccggaaaaatgaaaagatagaatttatggaggaccacatcaaacaactggtggaagaaattaggaaaaaaacaaagaaaatctacaaacacttggaacagaaatagaacgtcttattaaacaccagcatgaactagaacagaggacaaagaaaacctaaaacaagcctcttgctcagtaaagagacaaaagccacacaggagtaggtgccactgacctctattgttggagactttgttccactttttgtttcagccagtaaaaatattgttttgcttcatctgtacacaaaaaaatacccttttacaatatgaatgcattgctgtatatactgtaagactgaaagctttgatgaaatttgtttttgtatggtg

SEQ ID NO: 1082 - DNA, 3071 bp, Homo sapiens
cgtcggctgtgtttctcaccgcggtcttttcctcccactcttggctggttggaccccgctatggaaaagttggcccctgagccagagctccagcagccttgttagggcgtggcctgaggcttggataagtgggaggaaaaagtcctggatttcgagtcagaacatctggattagaatcctacttctttcacttgataatcttgttacctgtggaaatcagaagagagaatatagtaaaaatacgcagtacagtcccagatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagttaattaaagaaaataagaagcatcaggagctcttcgtagacatttgttcagaaaaagacaatttaagagaagaactaaagaaaagaacagaaactgagaagcagcatatgaacacaattaaacagttagaatcaagaatagaagaacttaataaagaagttaaagcttccagagatcaactaatagctcaagacgttacagctaaaaatgcagttcagcagttacacaaagagatggcccaacggatggaacaggccaacaagaaatgtgaagaggcacgccaagaaaaagaagcaatggtaatgaaatatgtaagaggtgagaaggaatctttagatcttcgaaaggaaaaagagacacttgagaaaaaacttagagatgcaaataaggaacttgagaaaaacactaacaaaattaagcagctttctcaggagaaaggacggttgcaccagctgtatgaaactaaggaaggcgaaacgactagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaatgagcttgatgcaaagcttagagtcacaaaaggagaacttgaaaaacaaatgcaagaaaaatctgaccagctagagatgcatcatgccaaaataaaggaactagaagatctgaagagaacatttaaggagggtatggatgagttaagaacactgagaacaaaggtgaaatgtctagaagatgaacgattaagaacagaagatgaattatcaaaatataaggaaattattaatcgccaaaaagctgaaattcagaatttattggacaaggtgaaaactgcagatcagctacaggagcagcttcaaagaggtaagcaagaaattgaaaatttgaaagaagaagtggaaagtcttaattctttgattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtgaacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacgaagaaaattagatcaggttgagagtggaagctatgacaaagaagtcagcagcatgggaagtcgttctagttcatcagggtccctgaatgctcgaagcagtgcagaagatcgatctccagaaaatactgggtcctcagtagctgtggataactttccacaagtagataaggccatgttgattgagagaatagttaggctgcaaaaagcacatgcccggaaaaatgaaaagatagaatttatggaggaccacatcaaacaactggtggaagaaattaggaaaaaaacaaaaataattcaaagttatattttacgagaagaatcaggcacactttcttcagaggcatctgattttaacaaagttcatttaagtagacggggtggcatcatggcatctttatatacatcccatccagctgacaatggattaacattggagctctctttggaaatcaaccgaaaattacaggctgttttggaggatacgttactaaaaaatattactttgaaggaaaatctacaaacacttggaacagaaatagaacgtcttattaaacaccagcatgaactagaacagaggacaaagaaaacctaaaacaagcctcttgctcagtaaagagacaaaagccacacaggagtaggtgccactg

SEQ ID NO: 1083 - DNA, 1576 bp, Homo sapiens; identical to SEQ ID NO: 1081

SEQ ID NO: 1084 - DNA, 4542 bp, Homo sapiens
attgttcctcagtgaacttccaccacatccctaaaatcttggaggggcagaccactggacaagagcaagacacaaatgtgaacatatgtgaggatggtaaagaccatatgcagagttcagctttagtagaaagtctaattacagtaaaaatggcagctgagaatagtgaggaaggcaatacctgtattattcctcaaagaaatttgttcaaagctttatcagaagaggcttggaactcagggtttatggggaactcatctagaactgctgacaaagagaatactttacagtgtccaaaaacacctttgcgccaggatttagaggcaaatgaacaagatgcaaggccaaagcaagagaaccatcttcactctctgggaagaaataaggtgggttaccatttacatcccagtgataagggccagtttgatcattccaaagatggttggttaggccccggccctatgccagctgtacacaaagcggcaaatggacactcaagaaccaagatgatatcaacctccatcaagacagctcggaaaagtaaaagggcatcagggctgaggataaatgattatgataaccagtgtgatgttgtttatatcagtcaaccaataacagaatgccactttgagaatcaaaaatcaatattatcttctcggaaaacagccagaaagagtactcgaggatactttttcaatggtgactgttgtgagctgccaactgttcgtacactggccagaaatttacactcccaggaaaaagcaagctgctcagcattggcatcagaggcagttttcactcctaagcagacccttacaattccagcccctagacatacagtagatgtgcagcttcccagagaagacaaccctgaagaacctagcaaggaaatcacctctcacgaggaaggaggtggagacgtttcacctcgaaaagaacctcaagagcctgaggtttgccccacaaagattaagccgaacctgagcagctcccctaggtcagaggaaacgacagcctccagcctggtgtggcctctccctgctcaccttcctgaagaggacctgccagaaggtggctccacagtctcagctcccacagcaagtgggatgtcttctcctgaacacaaccaaccaccagttgcactgttggatacggaggagatgagtgtaccccaggactgtcacctccttccctccactgaaagcttttccgggggagtcagtgaagatgtcatttctaggcctcattctcctcctgaaatagtcagtagagaagaaagtcctcagtgctcagaaaatcagagttccccaatgggcttggagccccccatgagtctgggaaaggctgaggacaaccaaagcatcagtgctgaggttgagtctggagacacccaggagctaaatgtcgacccactcttgaaggaaagcagcacttttactgatgaaaaccccagtgaaactgaggaaagtgaggcagcaggtggtataggaaaattagagggagaggacggtgatgtaaaatgcctgtcagaaaaagacacgtatgatacaagcattgactcactcgaagagaatttggacaagaagaaaaaaggtaaaaaattccctgaggcctctgataggtgcctaagaagtcaactttcggattcttcctctgctgacagatgcctaagaaatcagagttcagattcttcctcagcttgtcttgaaatcaaagttcctaaaaatcctagtgcaaaacgttcaaaaaaagaagggcaccctggtgggacaacacctaagggccttctacctgacagtttccacacggaaactctggaggacacagaaaagccaagtgtcaatgaacgcccctctgagaaagatgctgagcaggagggcgaaggcggggggatcatcaccaggcagactttgaaaaacatgctggacaaagaagtcaaggagttacgaggagagattttccccagcagggaccccataaccacagctggacagccactgcctggagagagattggaaatctatgttcagtctaaaatggatgagaagaatgctcatatcccctcagaaagtattgcttgtaagagggacccagaacaggcaaaagaagagccagggcatattcccacacagcatgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatcaagaatgagaaaatggaatgcccagatgctctggctgtggaaagtaagccaagtcgtaagagcgtatgcatcaaccctctgatgtcccccaagcttgccctgcaagtggatgcagatgggtttcctgttaagcccaagagtactgaaggaatgaagggaaggaaggggaagcaggtgtctgaaatcttgcctaaagcagaagttcagagtaaacgcaagagaacagaaggcagcagccctccagatagtaagaacaaggggcctacggtgaaagccagcaaagaaaagcatgctgatggagccaccaaaacccctgctgccaagaggccagctgcaagggacagaagcagccaaccccccaaaaagacgtctttgaaagagaataaagtgaagatccctaaaaagtccgctgggaagagctgccctccctccaggaaagaaaaagagaatacaaacaaaaggccttcccagtctattgcctcggaaacactgacgaaacctgcaaaacagaagggggccggtgaatcctcttcaaggcctcagaaagccacgaataggaagcagagtagtggaaagactcgggccagaccctcaacgaaaaccccagagagcagtgcagctcagagaaagcgaaagctgaaggcaaagctggactgttcgcacagcaaacggaggcggctggatgcaaagtgattggaaagatggtagccaagagtaaaactgttctatagaagtaaccttttattttgcattaactaaatctgcttttataagcttatcaagcctttcaaatttacagttaatggagaacaccgtaatttgagatgtcagaaaatgcatctcagatggagaagggaacttgcagagtccttctctgaggctaagggaagttatatattatattctggttgttccttgggttttaaacttggaaccaagcagttttcgtttttaaaagtacagtgccttatttatcctttttgtttttaaatttacaaaagctaaaaagctgatctatgtgattaaaggcttgtattttatacttgatgcacaagcacttgtactgtagccgagaagaccaccatcatgcacataaaaggagcttttcagcagccaccctgcagcatctgcccacgaacagatgcccttctttgcaaaccccagcagtgaacttccctctctgtcttgtttgtttgtttagatgatgtttgaaagctaaaccaaatcattttatggtatgcagaggatttataattataaaagattactatttctgttacccccttttaaaaaagatcatgttcattgttggtccctcctctcacctttgatgttttgtcatttgagagcatgtattctaaattatgtgcccatgggacaagag

SEQ ID NO: 1085 - DNA, 2967 bp, Homo sapiens
caaccaataacagaatgccactttgagaatcaaaaatcaatattatcttctcggaaaacagccagaaagagtactcgaggatactttttcaatggtgactgttgtgagctgccaactgttcgtacactggccagaaatttacactcccaggaaaaagcaagctgctcagcattggcatcagaggcagttttcactcctaagcagacccttacaattccagcccctagacatacagtagatgtgcagcttcccagagaagacaaccctgaagaacctagcaaggaaatcacctctcacgaggaaggaggtggagacgtttcacctcgaaaagaacctcaagagcctgaggtttgccccacaaagattaagccgaacctgagcagctcccctaggtcagaggaaacgacagcctccagcctggtgtggcctctccctgctcaccttcctgaagaggacctgccagaaggtggctccacagtctcagctcccacagcaagtgggatgtcttctcctgaacacaaccaaccaccagttgcactgttggatacggaggagatgagtgtaccccaggactgtcacctccttccctccactgaaagcttttccgggggagtcagtgaagatgtcatttctaggcctcattctcctcctgaaatagtcagtagagaagaaagtcctcagtgctcagaaaatcagagttccccaatgggcttggagccccccatgagtctgggaaaggctgaggacaaccaaagcatcagtgctgaggttgagtctggagacacccaggagctaaatgtcgacccactcttgaaggaaagcagcacttttactgatgaaaaccccagtgaaactgaggaaagtgaggcagcaggtggtataggaaaattagagggagaggacggtgatgtaaaatgcctgtcagaaaaagacacgtatgatacaagcattgactcactcgaagagaatttggacaagaagaaaaaaggtaaaaaattccctgaggcctctgataggtgcctaagaagtcaactttcggattcttcctctgctgacagatgcctaagaaatcagagttcagattcttcctcagcttgtcttgaaatcaaagttcctaaaaatcctagtgcaaaacgttcaaaaaaagaagggcaccctggtgggacaacacctaagggccttctacctgacagtttccacacggaaactctggaggacacagaaaagccaagtgtcaatgaacgcccctctgagaaagatgctgagcaggagggcgaaggcggggggatcatcaccaggcagactttgaaaaacatgctggacaaagaagtcaaggagttacgaggagagattttccccagcagggaccccataaccacagctggacagccactgcctggagagagattggaaatctatgttcagtctaaaatggatgagaagaatgctcatatcccctcagaaagtattgcttgtaagagggacccagaacaggcaaaagaagagccagggcatattcccacacagcatgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatcaagaatgagaaaatggaatgcccagatgctctggctgtggaaagtaagccaagtcgtaagagcgtatgcatcaaccctctgatgtcccccaagcttgccctgcaagtggatgcagatgggtttcctgttaagcccaagagtactgaaggaatgaagggaaggaaggggaagcaggtgtctgaaatcttgcctaaagcagaagttcagagtaaacgcaagagaacagaaggcagcagccctccagatagtaagaacaaggggcctacggtgaaagccagcaaagaaaagcatgctgatggagccaccaaaacccctgctgccaagaggccagctgcaagggacagaagcagccaaccccccaaaaagacgtctttgaaagagaataaagtgaagatccctaaaaagaaagaaaaa

SEQ ID NO: 1086 - DNA, 1064 bp, Homo sapiens
gaacacctcccgtcctagcttattgccggagtatgatcagagaatggaagaatgactgtcagaggattgaaaaacagagggctagtgacacaatggtgcaagaaaggaagaatgaaaagccagttagaatatttaataccaactcttcctttcaggatcaagccccaacgtgttgccaagaggatctgagttctgcttcaccgttgcggatatggagcaaattctacagatcagacccacggattgcccttgggaaatactcccccttggaaaaagagatcctacgtctaggtggcattcacaccatagcagcaagaaggcttttggcttacaagcaagaggaagaatgcagaatgctcaaggaactacagttgctgtctccggactacaaacaagcaatggagtataaaaagaaacattcctctccttgtgctatttgtgtacccctagaaaaaatatggacagcaaaggtgattgcgcccctggaggcatttaaaatgccacaacgagagcaggtgaacgtcagtaagcacatagagaggatgaggcttgctcgggctctgggaaatcatcagcctttaccctacattgaaaggtttacacgctcctcatttctgtctggggtgggcctgggtccaatggcaaaaaataaggccagacgaaaggaagacaactatgacacccataattgtgatgatgccaaccaagataagaaagaggaggcagagggaaaaaacacaaaaagacgagaaataaaaatgaatgtagttttcaagtcaaaagaaccaaaaaaatgtttaacataccatggaaatgatcgcaaatcattcctccccgcaaagaaaccggaacggtccatcgcaggcctaacaaaccgaaatcttttctgcatatcagaattccctggtgacttaatgctaatgaatcaggattttatatcacggagagaccacttcagtgatctggtcaagacctacagcctggaagaagagagtatctggaaagagcgcatgcgtaaagcaactccttatcattattaaagttttatttgttgcccagggtaa

SEQ ID NO: 1087 - DNA, 628 bp, Homo sapiens
actgtcagaggattgaaaaacagagggctagtgacacaatggtgcaagaaaggaagaatgaaaagccagttagaatatttaataccaactcttcctttcaggatcaagccccaacgtgttgccaagaggatctgagttctgcttcaccgttgcggatatggagcaaattctacagatcagacccacggattgcccttgggaaatactcccccttggaaaaagagatcctacgtctaggtggcattcacaccatagcagcaagaaggcttttggcttacaagcaagaggaagaatgcagaatgctcaaggaactacagttgctgtctccggactacaaacaagcaatggagtataaaaagaaacattcctctccttgtgctatttgtgtacccctagaaaaaatatggacagcaaaggtgattgcgcccctggaggcatttaaaatgccacaacgagagcagaattccctggtgacttaatgctaatgaatcaggattttatatcacggagagaccacttcagtgatctggtcaagacctacagcctggaagaagagagtatctggaaagagcgcatgcgtaaagcaactccttatcattattaaagttttatttgttgcccagggtaa

SEQ ID NO: 1088 - DNA, 922 bp, Homo sapiens
ggaagaggctgagaagtaaagatcaggaacaaggaggaggaggagcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactccggcctgggacgtaagaagatctctccagataagaggcaacatgtttcaagaaattttaatctctgggcatgtgactatgttccatcttgtcttgatggcttttcaaataaccaaatatcatacgtatataaagaagccatggtggtctcaagcttcagacgctttccacgatgctataaagagatatggaacgcttttacatttcttcctgagagaagctatacagaggttttgaaaaagaagcccaaagtaaggttcactgttgacaaaaaggttgtttcttcactggagtcctaatcctcccagaagatttttgatgaattttgtaatactggtatttcatcagacatcctaaaagtatatgttttctgatccagcaccactatttaatttttaaagtacttttatgatttttataaggtcaaaaaacattcaaatccttgtgaaatgaatttgtgatgacatacgcatgtgtaaataaacttttcagatggccacattta

SEQ ID NO: 1089 - DNA, 768 bp, Homo sapiens
cgccccgtctgccgggccatggtggcgctgaagggtgtccccgcactgctgtcccccgagctgctctacgcgctggcgcggatggggcacggggacgagatcgttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggatgctgaagcagggtctcggcaccctggccctgcagcccagctcagtgctgggcttggctcctctgcagggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaagagtccaattcc

SEQ ID NO: 1090 - DNA, 628 bp, Homo sapiens
ctgggcggagccggcccgagcttctcccggagtccctccccagacggcccgagagccctcgcgtctgggctgcccccgaggttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccc

SEQ ID NO: 1091 - DNA, 562 bp, Homo sapiens
cgccccgtctgccgggccatggtggcgctgaagggtgtccccgcactgctgtcccccgagctgctctacgcgctggcgcggatggggcacggggacgagatcgttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcc

SEQ ID NO: 1092 - DNA, 584 bp, Homo sapiens
gtgtccccgcactgctgtcccccgagctgctctacgcgctggcgcggatggggcacggggacgagatcggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaa

SEQ ID NO: 1093 - DNA, 2149 bp, Homo sapiens
cagggatgaagagcatgaatgcgaatgtacagcactgagctcgcgtctgccacatgagatgggcctctttctgtcgcccaggctggagtgcaatggtgtgatcatagctcactgcagcctcaacctcctgagctcaaatagtcctcctgcctcagcttcctgagttgcgactacagccatgaaccactgcatccagttcagccctcagagcctgcagaggtggctcatccttccctgttatgatctgaaactacccatatgggccaacaccacagagttctgtccccacgggccaaggagggcttctcaggatcctcaacttcttgcctggttgccagaccaatcactagaggtaagcctagaattgtacgattggaactcaatgacgttcacgctattcttagaaacagttgagccagtggcggtggagtctgaaggctctggaatcttttccttcgtgtggcagcaacttatttttcctgcggaggctcggtggtgcttttcttgggctcaggattgcggcttggatggctcattccctgggagtgcacacactgagccctttggaaaggcagcagcaggacaaggatcagtggcaggcaaagaggcaaaaaaagcaggacccgggttccataggcaactgctttatttacagttccaaaaacggtgcttgttcaactatcctgaacttttgtagaagttcaaacttggaaattgtagtgatgaaatgagagctgtgttttaaaaattacttttaactgtctatgaagcaagtctacattttggcaaaatgggctgcttttaatctggtcatgtgggatttaaaaaaagatttaattcagctggattttgcaaagcccttgcattgtatgacatgaggttatttaaggtatagttttgtcttcaaagagaagaaataagacacacgcatggatttttagagtaaaaataacgagagaatgttattacccaagagcatatattagctcacttgcagtgatgttgaactgggaacattccagaaggattccacgtgaagcagtgtttgcatttgtatgtttgaaatgctccataacaaaattgaaaaactgtaagagcaaaataaataataatacggattatgaagtaattaaaatgaagcagagaaaaaacctgtaggatgcagcctaaataaatgatactttaaatcaagcttatccaacccgtgtcttgtaggccacaatgtggcctaggacatatttgaatgcggcccaacacaaattcgtaaactttcttaaaatattgtgagactttttttttttttttagttcatcagctatcattagtgttagtgtattttacgtgtggcccaagacaattcttcttcttctgatgtggcccagggaagccaaaagactggccacctctggttcaaataaacatttacagcctcagtcacatatattagaaaatgaaaaagactgaaaaatttgccagctacttgcttgacacagtacaacagaaaaacaacagcaaagcaagcagaaagaaggcagaagaaggaaggaaaccataaagataaggagagcaattaatgagctagaaaacaaagtaataatgcagaaatcaacccaactaaaagccggttccttgaaaagagtgataaagccatctctggcaagaatgaccaaggacgagagaagaaaaagcatgaaaaagaaacagagcataactactgatggagattttaaagcctgtaagagaatactatggacaagttcctgacaatacatttggaaacagagaaatcagacaatctcctagaaaaatattaattacaaaaactgatgaaagaaaaagctggaatatacctataatcaacaaaagaagtgaatcaagttaataatctacagccttccttccccggatgcctccctctccaaaaaacaggccagacacagccaagtttacaaaatcttcaaagaacagataagcactactttgtataaactttttcaaagaatagaaaaaggacaacttcccacatcattttgtatgcataaccttgataataaaactgaacaaataaaatagagtgtagcaaaattataggtcattgttaattatgaaatgagtgtaatgatcttaaataaaatattagtaaaccaaa

SEQ ID NO: 1094 - DNA, 1756 bp, Homo sapiens
attgtgcctgcgctgccagcagccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagagcccacgtcctcagggacggtcctgccttgggacctttgcacttgctgttttctgtaattggaatgctctttgccagaaagctgcaagcctcgaccctcttttccttcaaatccctgcttcagtgtcaccactgcatcatggagggcctatttaaggcgaaaccacaatttctccaaaaggtgagttgtaagagtgatcacttgtcttaaaaggaggacaggcagtctctgccccatggggctgcatgggttttcggcatgacctctccctcccctggccacgtgggacgggcaaccatggcatggccaggagccctcatgccaggacagctgtgagaccaggaatcagcatcaccttgggacatgatggtacttggcaagatttaacatgaagctgtggggcatttgcccagttagagctgagaaaatggttttaacaggataggtaaactttttttcattctccaagacctatcctatgatagtgtccaatctaataattagccaatttagtccatttgatgaaaaaaattcccaaacatctcttcatgtcatcatgctatcagtttggctgggtatttgcatctcagtgctgctttggggtctcggagaggacgaagcctgtatgtggagggccggtctacagaaggggacaggatctcggacccctgattgaatgagcctatggatgaagactcctaggaatgaaggcatcttcaccagggttttgagaatcatcatttcacaatccacattccccagcttggcttttcctcacctcatgccccttgcatgtgccaaacccactgagaatttgctccctgtctgaccagcccaggatggtcacacaggcctggggcaatctcttgacctcactctcctgctttatgaaaaattttcaaatccaaagaaaagttgaaagaacgggacaatcaaaatatatacacccttcacctagggtcactcactgacacggtgccccctttgctttatctctgtgtacataagccttttttgactgatctacttgcaaattagtgtagatatcatgatatttcacccctgaatacagcaccattgtgtttcctattgtgtataatcacaatacagtgaccactcctaagaaaattaatgctaatttaatatcatctattatacagtccatatttaaatttctctggttatttcagaagtatcttttattgctctattttttattgtgctattttccaatccagaaaaaatatttgtatttattttgtcttttttttaagtctctttcagtattgaacagcccctctgctttttatccttatggcattgttaattgagaagtccctaagccccgttgtcttatacaatgtcccattttctggatttgtctgatcgttttctcctgagtagattcagattgaagtttttggtcagaaa

SEQ ID NO: 1095 - DNA, 415 bp, Homo sapiens
ctgccagcagccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtggcgaaaccacaatttctccaaaagcatctggccagatctgtgcaaattcaccaactacagaaagtgaaaagtttcccaaaatatgcctattaacctcgaggaatgacttctctttttgtcatcaaagtggatga

SEQ ID NO: 1096 - DNA, 562 bp, Homo sapiens
ctgccagcagccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagagcccacgtcctcagggacggtcctgccttgggacctttgcacttgctgttttctgtaattggaatgctctttgccagaaagctgcaagcctcgaccctcttttccttcaaatccctgcttcagtgtcaccactgcatcatggagggcctatttaaggcgaaaccacaatttctccaaaagcatctggccagatctgtgcaaattcaccaactacagaaagtgaaaagtttcccaaaatatgcctattaa

SEQ ID NO: 1097 - DNA, 875 bp, Homo sapiens
caggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagaaagctgcaagcctcgaccctcttttccttcaaatccctgcttcagtgtcaccactgcatcatggagggcctatttaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgc

SEQ ID NO: 1098 - DNA, 730 bp, Homo sapiens
aggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtggcgaaaccacaatttctccaaaagcatctggccagatctgtgcaaattcaccaactacagaaagtgaaaagtttcccaaaatatgcctattaacctcgaggaatgacttctctttttgtcatcaaagtggatgaagttttgtttgccttgggtttggcaggcagaaaacaacttccaggttgagctctcccctttacccagaagccactggccttcagttcctttctatgttgcacaaggaagtggcccaccttgcaggctttgctgatgagcttttatacctgtttaattgtgtgaattgcataaacacatgcaatcattagagtatagttgctctctcaataagtcttccagatggttctcttcctttccagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaa

SEQ ID NO: 1099 - DNA, 1875 bp, Homo sapiens
atgctcctgggtcgccgctacttgcagcccgcgggcgccgtagggctggcgcagggtgcggtggggcggttggtgatcatcctagcctgcggtagatggtgcgccctgccttccctgcccagacgtaagaaaagtgcactatgtcagaagagatggataatattacagctgaagaaattatagacaagcatctccaaaaagatttagatgcagaagaaaatcaaaatgtagcaaagacattgagaggcaaagtgagagaaaagctaaaaatttctaagattaataaaggtgaaaaatcttcaactgagcagctcattgatagcgaaatacatcaaaggtccaagttgtctccacagactgaagtctcattggatgaaagtctttcatttttcattctgagtggtgaagaaggttcagctttgggcaagtcttcagagcagagaccagtaaaccgtagttatcccaaatgcttttcacttggtgttaatttacaaaatgttgctgagagtgaagaggaagagtttatgaaagaattcattttgacagatatactcaaagtaaaagctgctgactatgaagatgatcaagaacaaataaaaaaacagaaggcaaatatttttgtaccaagtagttctccagtggttaaccagcgcaaactgccaaaagatatgatgccacgtattctagaagatgaaggattctatattcagagaaagccagaaatatacaaaaagacctgcaacaaaatggaaaatcgcctgcttaaactagaagaggcaaaatgttggtttggagaaagtggagaaataatgtcattacctacacctattaaacagtcatggaatttcagactaaatgtaaggaaggaacctttaaatccattacttaagaccatatacaggaagctctaatttctcccaattctgtgagggaggaaatggtcttgacaaatctcaggactctttttttccttagtgagcagcccccaactctgcctctggcactttttgctgcttttctttcttagtagtggcttatctagatcctaagagcccctcaagaaagactggacaggggtctaagtaggaagcactatactttcttctagtttattgttttgtccttcattaaaagaaatgtgtttatataatttacttacatatgacaaaataacttatcaaaaagaaataatcaaggagtatggatttccaaaggttgaccagagcagttttgtatgaggtaaagataaaagaacattcacctctcccattgaagaaccactgaggtttcttggttcactcccacaagcagagagcagagaccccaaatgtatctgcagggaatacccaatctgtatctgtttcctaaatgtgcatgggctggtgccagaaaaggcctcacttatttgtggtgatgttagtcttggaccaagcttgagattactagaagaggcaaagtagggacatgggtgaaggaatgtttttttctcccaggttaaaacctaactgtatgtgtcttgtggcatgcataagaaaactgatcagaatttttacttttatttgaatgtttttgtttaaatttaatgtgaagttttattattaaacaagtcccccactttgattgatttagcacaaaatgatgctgatggaaagatgaggatgccaaagacagactgaattcatgcaactcatttctgtacagctttgaatatttacatagctattttatttgttgttcagggtttttagaattgatagactgcttaagagtagggtagcaagtgttcataggaaagcatggaggacctttttatattgtatcctttttacatgagtgttactttttcaattaaattttttcctgaaaatcatgaaa

SEQ ID NO: 1100 - DNA, 1241 bp, Homo sapiens
gcggtggggcggttggtgatcatcctagcctgcggtagatggtgcgccctgccttccctgcccagacgtaagaaaagtgcactgtccgtccagaaagttgaaataaaaggaccatcatgaaaaaatctcaaagagaagatatttttaaaaaggttgcttccaaatcttggctcttgtgaacagtgctgcaacaaacatgggagtgcagatgtcagaagagatggataatattacagctgaagaaattatagacaagcatctccaaaaagatttagatgcagaagaaaatcaaaatgtagcaaagacattgagaggcaaagtgagagaaaagctaaaaatttctaagattaataaaggtgaaaaatcttcaactgagcagctcattgatagcgaaatacatcaaaggtccaagttgtctccacagactgaagtctcattggatgaaagtctttcatttttcattctgagtggtgaagaaggttcagctttgggcaagtcttcagagcagagaccagtaaaccgtagttatcccaaatgcttttcacttggtgttaatttacaaaatgttgctgagagtgaagaggaagagtttatgaaagaattcattttgacagatatactcaaagtaaaagctgctgactatgaagatgatcaagaacaaataaaaaaacagaaggcaaatatttttgtaccaagtagttctccaggtaacattctttcccagtaaaatattcaagtcattaacgaattatgttatgggataatagctttattgtatgctggataaataaaaaatactgatctaaaattatagtaacttttctatatttgtttttcatgacttccctgaattaagggaactgattaagagaactcattcttcatttaaaaaatgtacatatataggcatatgtatttatatatagagagagagagcgagcgagaaagtaagagacagtgagagagaggctttctgctagacttcagtagtagggtgtaattatagttgtttgtactacttatttggtcaatatccatttaatattttggactttaaagtaatatctaagttttattgttataaagtggttaaccagcgcaaactgccaaaagatatgatgccacgtattctagaagatgaaggattctatattcagagaaagccagaaatatacaaaaagacctgcaacaaaatggaaaatcgcctgcttaaactagaagaggcaagtgcaccacctaac

SEQ ID NO: 1101 - DNA, 3379 bp, Homo sapiens
gcggagacggcggaagcggagagcaacagcgcgccgagacttccagtgtcctactattgaagcctgcacctgctgcattgctgttttcctgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagagttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacatata

SEQ ID NO: 1102 - DNA, 3418 bp, Homo sapiens
gcggagacggcggaagcggagagcaacagcgcgccgagacttccagtgtcctactattgaagcctgcacctgctgcattgctgttttcctgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggggattctgatgcacataaagcccgagaaccactgctcaaagttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacat

SEQ ID NO: 1103 - DNA, 3036 bp, Homo sapiens
gacgcgcgccccagcggcgcgagcggaagagatagagcttcgcggagacggcggaagcggagagcaacagcgcgccggtgaggctgctgtcagaaaggaacttttacacagtttgccttcagagacagtctatcggcatgttgtagagttttattactaagaaaataaatgttacttacatgatggttttactcagcatttggtgtggtggatcttacataaacctttagaacttacattagagtgttcaagtcttctgagactccagagtcacctaagattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagagttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcac

SEQ ID NO: 1104 - DNA, 1032 bp, Homo sapiens
gcggagacggcggaagcggagagcaacagcgcgccgagacttccagtgtcctactattgaagcctgcacctgctgcattgctgttttcctgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttgg

SEQ ID NO: 1105 - DNA, 1340 bp, Homo sapiens
gcttcgcggagacggcggaagcggagagcaacagcgcgccgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatag

SEQ ID NO: 1106 - DNA, 1294 bp, Homo sapiens
caaaaattatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacat

SEQ ID NO: 1107 - DNA, 2422 bp, Homo sapiens
gctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccct

SEQ ID NO: 1108 - DNA, 838 bp, Homo sapiens
agtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaa

SEQ ID NO: 1109 - DNA, 387 bp, Homo sapiens
atgaagcataaatacaacacactgtcatggtacaaaaaagaaagatcaactcagcttagacggtttatagttcatcagccagaggttggcttattcttttttttaagggacgtagtctataactacatcacagaaaaaacaacatgtaggtgtccccttactcaagaaaggccttgtgacactggaggtaagtttggaagaatatggatctgtcaacctgaggaattgggaaagatgcaaatatggatctgtcaacctgaggaattgggaaagatgcaaatagataaaaacagaactatggtccaacagatgtggtatatttggtatggtggattagatacatccacaaattctttgctgcccatcctagtaagaggcatggcctaa

SEQ ID NO: 1110 - DNA, 1815 bp, Homo sapiens
agtgattaccaaagactggggagaggaaggcagatgggagaatggagaaagattggtcaacagacgctgactgtgatttttctcactaatgacaaaaggaataacctctagtgagaatgaaatgatgaagggtctttgaaattctctactctctgaacacagtgaatgtgaatgaaagatctcaggaagagttttcaaaaagcttattgctcaatcaccagcctttgcgaggagttgtggattgactgctgtctgcaataaagtcaccagaaactgccatagctctcaaggcaagcacatgctgataatgacaagctgctgagactcaaagctatgttttagccccaaccccagcacagactcaccacgaagctctttgatttccagacggaactttcatgaggacacaccacacttaactaaacccttgacctaacagacctatagtgaagatgaaaccccaaaggtagccaagggatttggtattttagtcatgttctttcatgccttagtacctttaaggtaagctcacacagaggtggccatgaaatggttaatagcaaaatccctgacttctgtagtcagtgagaaacatccgagagtgtgtcatatggtcaaaagcctctttgcgaaaaggaaaacatttcaagtcatagattcattcttttatttctactcattcattcattttcttcaataaacatttaggaagctcctactgtttgccaataactcaacagagctctggagaaacagatgaattcaatgtggccttttgactagggacgatcgcccaccacacttctgataacagacaagcccttcttcagcactacagggttagccaaccacagtattccatccccctggcctcagtcagaacctttgctccagaaattttcctctggaactatcaggaaggacttccagttacccctggggacgccattttggaaacctagtactgtcatggccaaattatctatctcggaggaacagcacctacaggagtgaagccaccacacagatggaaacaaaggaggaaggaagggaaagggagaggaaaaaaggaggaggaagaagaaagagagaagggggaagggaaaggaagataagaaggataccactcggcattgtttgcctggatccagtcctgccacaagccaataccaccaccaccctttttttaaaatcaattttatgaccctgaggcaataattcttgccctcctcccatgcatacttttcactacactgatcttaactacctgaaactgagaacatttagataaaaatcagagaatttgaggtcaatttagtagcacagcaaccacatacataaataattgcaaaaaaaagtgatgaagcataaatacaacacactgtcatggtacaaaaaagaaagatcaactcagcttagacggtttatagttcatcagccagaggttggcttattcttttttttaagggacgtagtctataactacatcacagaaaaaacaacatgtaggtgtccccttactcaagaaaggccttgtgacactggaggtaagtttggaagaatatggatctgtcaacctgaggaattgggaaagatgcaaatatggatctgtcaacctgaggaattgggaaagatgcaaatagataaaaacagaactatggtccaacagatgtggtatatttggtatggtggattagatacatccacaaattctttgctgcccatcctagtaagaggcatggcctaattcctctccccttgaaaatacactgacatttagtgacattttattaaatctgtacccttttgtaccca

SEQ ID NO: 1111 - DNA, 4329 bp, Homo sapiens
agatgggagaatggagaaagattggtcaacagacgctgactgtgatttttctcactaatgacaaaaggaataacctctagtgagaatgaaatgatgaagggtctttgaaattctctactctctgaacacagtgaatgtgaatgaaagatctcaggaagagttttcaaaaagcttattgctcaatcaccagcctttgcgaggagttgtggattgactgctgtctgcaataaagtcaccagaaactgccatagctctcaaggcaagcacatgctgataatgacaagctgctgagactcaaagctatgttttagccccaaccccagcacagactcaccacgaagctctttgatttccagacggaactttcatgaggacacaccacacttaactaaacccttgacctaacagacctatagtgaagatgaaaccccaaaggaagctcctactgtttgccaataactcaacagagctctggagaaacagatgaattcaatgtggccttttgactagggacgatcgcccaccacacttctgataacagacaagcccttcttcagcactacagggttagccaaccacagtattccatccccctggcctcagtcagaacctttgctccagaaattttcctctggaactatcaggaaggacttccagttacccctggggacgccattttggaaacctagtactgtcatggccaaattatctatctcggaggaacagcacctacaggagtgaagccaccacacagatggaaacaaaggaggaaggaagggaaagggagaggaaaaaaggaggaggaagaagaaagagagaagggggaagggaaaggaagataagaaggataccactcggcattgtttgcctggatccagtcctgccacaagccaataccaccaccaccctttttttaaaatcaattttatgaccctgaggcaataattcttgccctcctcccatgcatacttttcactacactgatcttaactacctgaaactgagaacatttagataaaaatcagagaatttgaggtcaatttagtagcacagcaaccacatacataaataattgcaaaaaaaagtgatgaagcataaatacaacacactgtcatggtacaaaaaagaaagatcaactcagcttagacggtttatagttcatcagccagaggttggcttattcttttttttaagggacgtagtctataactacatcacagaaaaaacaacatgtaggtgtccccttactcaagaaaggccttgtgacactggaggtaagtttggaagaatatggatctgtcaacctgaggaattgggaaagatgcaaatatggatctgtcaacctgaggaattgggaaagatgcaaatagataaaaacagaactatggtccaacagatgtggtatatttggtatggtggattagatacatccacaaattctttgctgcccatcctagtaagaggcatggcctaattcctctccccttgaaaatacactgacatttagtgacattttattaaatctgtacccttttgtacccatctttttcatgtggtgaaatgaaaaaatacagcacttctgctgtctcagcacattttcaagatattctaagaaatgtcttgaaaaagtaaatatataaagacagaaagtaaatgagtggttgtctagggctaggggttgggaatgggagtgattgcaaatggatatgagatttctgtttggggtgatggaaatgttctaaaattaggttgtgggaatggttgcacaactctgagaatatactaaaaaaacactgaattgtatactttaaataggtgaattttatgacatgtgaattacatctcaataaagctgttaaaaaatagatgaaatggacaaattccttaaaaaacaaaatttaacaaaactaatacaggaggaaatagaaaatctgaatgaaattaaatatcaatgaaattgattccttcatttaaaaatccttcccgcaaagtaaacttcaaatcaaaatagcttcaatgatgaattctgaacatttaagcaaaaaataataccaatcttatagaaaactcagagacttgaaaagaggagggtatcatttccaactaattttataagatcagcataacctcgaagcttccttctattccgagattactaagagttcataaagaagtattaaattttatgtacaaatttttctgggccaggtgctgtggctcacgcctgtaatcctagcactttgggaggccgaggtggcggatcatgagttcaggagatcaagaccatcctggctaacacagtgaaaccccgtctctactaaaaatataaaaaaaagttagccgggcgtggtggtgggtgcctgtagtcccagctactcgggaggctgaggcagtagaatggcgtgaacacaggaggcggagcttgcagtaagccgagatcgcgccactgcactccagcctgggtgacagagtgagacttgtctcaaaaaacaaacaaacaaacaaaaaatctgtatctattgagatgattatatatacatattttctcctttatataaaagggataatatgaccaagtgggatttatgccaggaatgcaatcttgggatcagcataaaaaggacaattgtaaaagattgtcaaattatacttcactaaaattaagaatttctgttcatcaaaagataccgttcagagaaggaaaagacaaaccactaactgagagaagatatttgccatcatccagtggtgtaccaagggcaaggtaatgggaaagtctgccttgtatgcagacagtaaaagggttcattgtctgaaaatgtaaaagcaatactaaaactcactgaaaatcactctgcactttattattatcatgcactggaattctaaacattatcataataaaatattcatctagaaaaaatatcttttattagtttaagttctaaatgaaagtatgatccacagatctggagtaatccaagatcttttcagagagtccatggagtcagaatattttcataactaaaacattgttttcctttttcattgtgttgactgtgtgcgctgatggttcaagacaatggtgactaaatctacttattccttagtaggaatcaaggcagtggcacagattatactagtatacattgtattcttcaccactacacacgaacagttaacaacaataagaaaaacctagttttacttaagaaatatatctaatgaggcagtaaacattttattatcatttaacttttttatggacgggcatggtggctcacgcctgtaatcccagcactttgggaggctgaggcgggcagatcacctgaagttgggagttcgagaccagcctgaccaacctctttagtagagaaaccccatctctactaaaaatacaaaattagccgggtgtggtggcacatgcctgtaatcccagctactagagagtctgaggcaggacaattgcttgaacctgggaggcagaggttgcagtgagcagagatcacaccattgcactctagcctgggcaataagagtgaaactccatcacacacaaaaaaaaaaaaattattgtcatttaactttttaattaaaatttcaattacaatttaaaaatttactaaaacatttaactttattaaatcctaaatgttcttaccaccaaaaaattatgcctgtgtgaggtgatgaaaacattaattaggttgactgtggtaatcctttcacaaagtacacacatatacatatatatataaccttttaatcaactatacctcaagctaggaaaaaatgaattaattaactttaaaataaaacattttattaaatatggaccttagcatacccatcttttttatgtgatgacatggaaaataaagcagttctgttgtctcaaggaaaagcactttgtgattatttgactgtgagctaatccagccacttttttttttttatggaacaccagtttgacttttaaaaaaacaactgataggctgtagttattcagacttagttattcagcagaaattttctttaaaatgaccaaagtaagcctggcacttcaaggaaaagaactaaaatatctgttatctaaaagttgagcttttaaacctaaattgcatgttggaaacttgtatctgctactgtgagcttgaaagctgctgtgagcttgaaaactcttctgatgagattggtgatgatattaataaatatagtgtttttgctactataaaatgaaatgtgtctatcaatagcattttagagaatctctcaattctatccaaaatgatgttattctgataataaagcccagatctgcaactttaa

SEQ ID NO: 1112 - DNA, 1396 bp, Homo sapiens
gaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagtttctcagaattttacagcagtgtga

SEQ ID NO: 1113 - DNA, 6740 bp, Homo sapiens
gaggccgggcagggggcggggccggcgaatgcccgtcccgacccgtcgcgcctcccctgttagctccctgccagccgaggcggggcgaacctctgccctgttgcgtgggagtgactcacagctcccgccccttttggctccgctttctcgcggccagtccctcgcaccacgtgccctcctggccgcgcccccagctgccctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcagccaccgccggaggctaatggggtgatcatgatgttgaagagctgcgacgcggccgccgccgtggccaaggcggcccccgcccccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggttgtacatagtctcccagtctacatgtcctggctgttaatcatcttggccccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagtagctggaattacaggcacgtgccactacgcccggctactttttgtattttgtttttagtagagacggggtttcaccatgttggtcaggctggtcttgaactcctgacctcaagtgatccacccacctcggcctcccaaagtgctgggattataggtgtgagccactgcacctggccttttttttttttttttttgtattcttgccagtacagtatatggtttttctaccccaattacatactgggttttgtaccacatcactaaaggcccaaatcattgaagatacaaaaccgtacatgcaggctggttgtctggttagtcaatggctgatttgcttcaactgtctagtatgtatgtgcagcctgaaactggctccttaaaaggaaagccgggtcagtcatcttgaaaaaatgacatgtaaaagtaaatcgataattgttttgagagacggtacatgttttaaaggttggccttaagcttcagtaacattgtcattttgtgaccttttgttgtcacacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctcacgtcatttcaatgttgtgactatgtactaaatgcactaagactgggtattctcttagaagagtgcgttttgttaaacagatggcagttcactctcattagttctatttgtcaatattacagccacacacttcaggataacttactcaaatgtgaagtcatgggaagctatggctagtaacaggaatgcttatgaaaaatttggagggcaagcacgagcaagaggcttttgccactcactagcacagccagagcaaggatgaagcaatgaagtcttgttcctagtggtgcttgtatgtcagaagccatagtgagctcagcacagggcgttctgcacatcatctctttaatccaagaaaaacaaaatggcggatgaaactcctattgacctgggatacaaagccactgactttggctcttgatcttttggtgggttctgaatcactccttctgtattagggcatatactttcactctaaaacattgtggtaaatgaaataaatcttgtacagatgtcgttggc

SEQ ID NO: 1114 - DNA, 6460 bp, Homo sapiens
cctttccaactgcctgttggaagccgctgtaaaacgtcgtgaggagcgccgctgctttacggctgcctctcccagactagagccccggagcgcccaccgccgtcagccgcgtcttcaagctagtcggccccgcggagagcgagagaccctgcgcaccgcagccctctccgctgcgcccattcctgccgccggcgatgtaactcggggaggcagcggtgcccgctggcccggggttgagacaggcggcaggtgcctgtgaggcgggcgggtgccgggggccagcaggatggaggaaagcatggaagaggaggaggggggcagctacgaggcgatgatggacgaccagaaccacaacaactgggaggctgcggtggacggcttccggcagcccctgccacctccgccgcccccctcgtcgatcccggcccctgcccgagagcctccgggggggcagctgctggcggtgcccgcggtctccgtggacaggaaaggccccaaggaggggctcccgatggggccgcacccaccgccagctccaccatcaacatcaacacctccacctccaagttcttaatgaatgttataactattgaagattataagagcacatactggccaaaattggatggtgccatagatcaacttttaactcagagtcctggtgactatatccccatatcctatgaacagatatacagttgtgtgtataaatgtgtatgccagcagcactcggaacagatgtatagtgatctgattaaaaagataactaatcacttagagagagtctcaaaggagctgcaggccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttattaagtccaaatacacagtggtgtggggttcctgatcacttcattttaaatgaatgagataattacttaaaaaaagtctgtcatttgaacattatatttgagtgtgatagggaagaagtagcactgctgtcctaaggctcccttccagctgtggcaaagctatatttctgtttctccacatccacagtgctttttagtccatcataaaagtttctgaagcttattctagctgttgttgaaagcccaagaaaaatagatgtggcaagagaaaaatacttttcttctcaattttgcttgaatcttaattgagcataggcttctctactaggcaacatcagactaatagtatttacctcttcagagaacttgaggggaaaagaaacatcccagggatgctgtcgcatgtctgctctgcaggttcttcatacagctgcctctgccaattcagtttattttttggggggagtggtgtgggtgggagagttagaagtgggatattgggagcaagtaagtcacccaataattgaagtccttgatttgtaaaactgttatacagagaagtaaagataaaggttgtcagatttattttttaaagtacttaaccagagttcgtggattttgtggactttaattggactcaattcactctgtgagcatcctggattgcatcgatgaacactgaattactgtaagaacatagacaggctctcactatgacctggacagtttaagttgctacactggtaacattctagtatcaaggagaattccattcatcatgacattcacattttacttttctcaatggaatgcttgcttcaggcttaccaatcacacctagaactgaagtctgagtgagtggtattaataatttttctgaaaggaataaaattggaatgtttctaaatgtggagaaattcttcagtatcctaataatatacccaaatgctttttctgggagagagcattcttttacaaaagaactttccctataaaagcatcacagtataatgtgaattggcattaaaatctttggatgcttttgcattattaagttcatggagaaatatattctttttactatgtatgtattaataaaaagtgggcaaagtaaagtttgcaaaatttagtttctctaaatttttgcacagtgactgcagctggctatgggtcagctcttaatacaacaaaaccttgactggaagtcactatagaaaggttgtacatagtctcccagtctacatgtcctggctgttaatcatcttggccccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagtagctggaattacaggcacgtgccactacgcccggctactttttgtattttgtttttagtagagacggggtttcaccatgttggtcaggctggtcttgaactcctgacctcaagtgatccacccacctcggcctcccaaagtgctgggattataggtgtgagccactgcacctggccttttttttttttttttttgtattcttgccagtacagtatatggtttttctaccccaattacatactgggttttgtaccacatcactaaaggcccaaatcattgaagatacaaaaccgtacatgcaggctggttgtctggttagtcaatggctgatttgcttcaactgtctagtatgtatgtgcagcctgaaactggctccttaaaaggaaagccgggtcagtcatcttgaaaaaatgacatgtaaaagtaaatcgataattgttttgagagacggtacatgttttaaaggttggccttaagcttcagtaacattgtcattttgtgaccttttgttgtcacacctgtaccctaacctgacaggaattaactactgtttttttgtggggcagaaagcaaaacctggtgttgtgacttttatcctaatggttcttaggcaaggttagtgagaagaaacacaaacccagatgcatgcattgtgcattattttgtagacaagctactttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctcacgtcatttcaatgttgtgactatgtactaaatgcactaagactgggtattctcttagaagagtgcgttttgttaaacagatggcagttcactctcattagttctatttgtcaatattacagccacacacttcaggataacttactcaaatgtgaagtcatgggaagctatggctagtaacaggaatgcttatgaaaaatttggagggcaagcacgagcaagaggcttttgccactcactagcacagccagagcaaggatgaagcaatgaagtcttgttcctagtggtgcttgtatgtcagaagccatagtgagctcagcacagggcgttctgcacatcatctctttaatccaagaaaaacaaaatggcggatgaaactcctattgacctgggatacaaagccactgactttggctcttgatcttttggtgggttctgaatcactccttctgtattagggcatatactttcactctaaaacattgtggtaaatgaaataaatcttgtacagatgtcgttggc

SEQ ID NO: 1115 - DNA, 1060 bp, Homo sapiens
agcagatgtgttctggctgaatgctgagtaactaaatgtgacctgtactaatggaaagagtagcataattagcttcagatgaccactactcctgtgctctctagatttgccagccctccagatctctatattgaaagatttaatatagctcttggacaatatatgggagcattgcagagcattgtgcctcttttcatatatatgaataagttttacatcgaaaccaagcttaacagagacttaaaagatgaccttataaagctgtttacggaacatgttgcagaaaagcacatttacagcctaatgcctttacttttagaagcccagtcaacaccatttcaggtcacaccttcaactatggcaaatattgtgaaaggcctgtataccctcagaccagagtgggttcagatggctccaactctattttctaaatttattccaaacattctccctccggcggtggaatctgaactttctgaatatgctgctcaagatcagaaatttcaaagagaacttatacagaatggttttacaaggggtgaccagtcccggaagagagctggggatgagttggcttataatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttgctttcacttgacagggccactgggcaaggaactgagggtggcatccagccaacagctaccaaggaactgaggccttcaatctaatagcccgaggggctgtaaatcctgctgacggtccgagtgaacttggaatggatgttggtccagttgaatcttgagatgactgtggccctggctgacaccttgatcacagcctagcggcaaagcctgagacagagaattcagctaagctgtgcccagactcctgacccagggaaactctggaataaccgtgtgctggtttaagccactaaa

SEQ ID NO: 1116 - DNA, 3333 bp, Homo sapiens
gggcggcggcgtgagggctccgggtcgctggcggcgtggacacctgagtcccggggtaggggtctcccgcgaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggaggagtgtgctgcctctgctccccgtctctggaggagagcacctccagtccctccgagcctgaagatgtcatcgacttagtgcagccagcacctggcgccggggaagccgagggccttccagaggggacccaggcagcagggcctgcacctgctgggaaggagcacaggaaacaagatgctgagactcctccacctccagaccccccggctcccgagacccttcttgcgccaccacccctgcctagcacccccgatccccccaggagggagctgcgcgccccctccccgccggtggagcaccccagactcctgcgctctgttcccacgcccctcgttatggcgcagaagatttccgagaggatggcggggaacgaagccctctcgcccacctccccgttcagggagggccggcccggggagtggaggacacctgccgcccgggggccccgcagtggagaccctggcccggggcccagccacccggcgcagcccaaggcaccccgcttccccagcaacatcatcgtcaccaacggcgcggcccgggagccccgcaggaccctgtccagggcggccgtcagcgtgcaggagcgcagggcgcaggtgttggccaccatccacggccacgccggcgccttccccgccgcgggggacgccggcgagggggccccagggggcggctcctccccggagcgggtggcgcgtggccggggcctgccgggccccgctgagagtctccgggcagggggtcaggctccgcggggcccggcgctggccaacggcttcccaagtgcgcacgaggccctgaagagcgcacccagctccttcgcgcccgctgggaagtccctctgcttccgccctggcccggccctgcccagcacgcgggcccgtcagagcttccccgggccccggcagcccaacggcgcccaggactggcgccgcgcagactccctgccccggccccagggcatcaccgtgcagttcgcgggccgcggctcctcggaggaggcgcgcagggaggccctgcggaagctggggctgctcagggagagttcgtgagggccgcgcgggctccagtccaccccgtttctccccaccctgaagagagggtgaaagagtcgctgcacccaggagctgtttggtctaaaatggaagtgacagcgggagcccctgccctctgtggcacatcggagtctagaggtgcctggctggggcctcctggctgagcacgcaccgcaagctccagccaccggcacagagaactcttccctaaaggaatctggccgagggcttgtctcccttttcccaagaactgagagagagagaataacctgttagacccataggtttccgtgatgtgtaaatgccatcttttgggggttgggaggagtaggactggtctgattatcattcttgagtctcatctaccctcttctcgaagtacatgacatgaaagttcagatcccttccactcaggattctcgccgccttttctaagaaaataataaaaaaaaatgcttgtttcattttttaatgtcttaatatacttgcttttgtttttgaagggtgaggcatcatggtactttgcttttgtttcttgacgtactttagtttgcccagttttgttttttactgaaaactgaaatgaaacctttagatattgagttttgggagtgaaatggaaaggtggtaattttgagaaagcaagtctcatcagactctgaggtctgggacgtgtgcgtgagcctgtgtttgtgtgtgtatgtttttagatacgtacgtgtcaacacatacatgcataggtatcctgtgtgtccacatgcatcattattatataaatagaaacttctgaacaccctcctaagtcactacaggatgccagcgcttcctattcttgggtagacagagccacctcagcatcctgatggatgatacaagaaattgttacttcctagtatggaagtgtcttaaggacacgtctccatgatattttggtgaaccaaaagtgctttatcctcaacaaaatgttcctctgttcccagttaaagtaatattccctgcttccaagtaagcaagactgttcactaaagaaggaactttttagaaaactaatctcctttatcatccaattttagttctgcatgttccgaggtagccagtcaacagaaggaagcaaaagattcttaaagatccaccgactgtcatgttccacaagcaagatctcagggtagggaaaaaccagtgaatgaggttacacagcaggaaaagaaccggtttcctcccagactatgtcttacacgctgagttatgccacaagcgttatcatcaaaactatttaaggctggagtcttagacctctaaaaatagacaggaagggctgccctgagcagtgacacctttgtgtttttatgtctccgccagcgccgtaacagagcctgtttctttcccgttgagtattacttaaattcaggcttaaatgtgctatgaagggcatttttcatagtatcccatttgccttgtaagttatataaagtgcatgattataattttttccttagaaatgcaatatttagtttcatccagctcttatgaataataacctcatagattcctgatcttaatttaaataggtgctttaattttacagctttcaaaagtagttactgtaaattttactcctgttaatgctggattggtttaaaggatttataagggctgtgtttgctctttacaaggcaagatgccatacagtgttcaataatagaaggtcttgatacaaccgacattttaaatattctttatacatgaggactgcatctttttcactgaccctatgatttcactgtgagtagggtgaactggactgcatattagtttatttgttgccataatcacatttttgaaaaataaatttaagagttttttcttaa

SEQ ID NO: 1117 - DNA, 1232 bp, Homo sapiens
ggagcaccccagactcctgcgctctgttcccacgcccctcgttatggcgcagaagatttccgagaggatggcggggaacgaagccctctcgcccacctccccgttcagggagggccggcccggggagtggaggacacctgccgcccgggggccccgcagtggagaccctggcccggggcccagccacccggcgcagcccaaggcaccccgcttccccagcaacatcatcgtcaccaacggcgcggcccgggagccccgcaggaccctgtccagggcggccgtcagcgtgcaggagcgcagggcgcaggtgttggccaccatccacggccacgccggcgccttccccgccgcgggggacgccggcgagggggccccagggggcggctcctccccggagcgggtggcgcgtggccggggcctgccgggccccgctgagagtctccgggcagggggtcaggctccgcggggcccggcgctggccaacggcttcccaagtgcgcacgaggccctgaagagcgcacccagctccttcgcgcccgctgggaagtccctctgcttccgccctggcccggccctgcccagcacgcgggcccgtcagagcttccccgggccccggcagcccaacggcgcccaggactggcgccgcgcagactccctgccccggccccagggcatcaccgtgcagttcgcgggccgcggctcctcggaggaggcgcgcagggaggccctgcggaagctggggctgctcagggagagttcgtgagggccgcgcgggctccagtccaccccgtttctccccaccctgaagagagggtgaaagagtcgctgcacccaggagctgtttggtctaaaatggaagtgacagcgggagcccctgccctctgtggcacatcggagtctagaggtgcctggctggggcctcctggctgagcacgcaccgcaagctccagccaccggcacagagaactcttccctaaaggaatctggccgagggcttgtctcccttttcccaagaactgagagagagagaataacctgttagacccataggtttccgtgatgtgtaaatgccatcttttgggggttgggaggagtaggactggtctgattatcattcttgagtctcatctaccctcttctcgaagtacatgacatgaaagttcagatcccttccactcaggattctcgccgccttttctaagaaaataataaaaaaaaatgcttgtttcatt

SEQ ID NO: 1118 - DNA, 1183 bp, Homo sapiens
gggcggcggcgtgagggctccgggtcgctggcggcgtggacacctgagtcccggggtaggggtctcccgcgaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggaggagtgtgctgcctctgctccccgtctctggaggagagcacctccagtccctccgagcctgaagatgtcatcgacttagtgcagccagcacctggcgccggggaagccgagggccttccagaggggacccaggcagcagggcctgcacctgctgggaaggagcacaggaaacaagatgctgagactcctccacctccagaccccccggctcccgagacccttcttgcgccaccacccctgcctagcacccccgatccccccaggagggagctgcgcgccccctccccgccggtggagcaccccagactcctgcgctctgttcccacgcccctcgttatggcgcagaagatttccgagaggatggcggggaacgaagccctctcgcccacctccccgttcagggagggccggcccggggagtggaggacacctgccgcccgggggccccgcagtggagaccctggcccggggcccagccacccgccggcgctggccaacggcttcccaagtgcgcacgaggccctgaagagcgcacccagctccttcgcgcccgctgggaagtccctctgcttccgccctggcccggccctgcccagcacgcgggcccgtcagagcttccccgggccccggcagcccaacggcgcccaggactggcgccgcgcagactccctgccccggccccagggcatcaccgtgcagttcgcgggccgcggctcctcggaggaggcgcgcagggaggccctgcggaagctggggctgctcagggagagttcgtga

SEQ ID NO: 1119 - DNA, 1647 bp, Homo sapiens
gggcggcggcgtgagggctccgggtcgctggcggcgtggacacctgagtcccggggtaggggtctcccgcgaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggaggagtgtgctgcctctgctccccgtctctggaggagagcacctccagtccctccgagcctgaagatgtcatcgacttagtgcagccagcacctggcgccggggaagccgagggccttccagaggggacccaggcagcagggcctgcacctgctgggaaggagcacaggaaacaagatgctgagactcctccacctccagaccccccggctcccgagacccttcttgcgccaccacccctgcctagcacccccgatccccccaggagggagctgcgcgccccctccccgccggtggagcaccccagactcctgcgctctgttcccacgcccctcgttatggcgcagaagatttccgagaggatggcggggaacgaagccctctcgcccacctccccgttcagggagggccggcccggggagtggaggacacctgccgcccgggggccccgcagtggagaccctggcccggggcccagccacccggcgctggccaacggcttcccaagtgcgcacgaggccctgaagagcgcacccagctccttcgcgcccgctgggaagtccctctgcttccgccctggcccggccctgcccagcacgcgggcccgtcagagcttccccgggccccggcagcccaacggcgcccaggactggcgccgcgcagactccctgccccggccccagggcatcaccgtgcagttcgcgggccgcggctcctcggaggaggcgcgcagggaggccctgcggaagctggggctgctcagggagagttcgtgagggccgcgcgggctccagtccaccccgtttctccccaccctgaagagagggtgaaagagtcgctgcacccaggagctgtttggtctaaaatggaagtgacagcgggagcccctgccctctgtggcacatcggagtctagaggtgcctggctggggcctcctggctgagcacgcaccgcaagctccagccaccggcacagagaactcttccctaaaggaatctggccgagggcttgtctcccttttcccaagaactgagagagagagaataacctgttagacccataggtttccgtgatgtgtaaatgccatcttttgggggttgggaggagtaggactggtctgattatcattcttgagtctcatctaccctcttctcgaagtacatgacatgaaagttcagatcccttccactcaggattctcgccgccttttctaagaaaataataaaaaaaaatgcttgtttca

SEQ ID NO: 1120 - DNA, 476 bp, Homo sapiens
ccaatcagatgtctggtcaagattgttttcaggtgagattttactttaggaaaatctggttttggtatctttttcagtgatggcgaaccgacactaggaaacttcttccctcgaggcctgttaaaacccagcctctctaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggagga

SEQ ID NO: 1121 - DNA, 799 bp, Homo sapiens
ggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggaggcgatggtaaactagacccactgtgtgaaaaggccaggatagccgtgctgaatgcctactgatctcctcatggaacaggcatctcaagtcggcacaacagcagctgccccagccattctatgatgcaggcagaagtggctgtgccacggtgtggacactgggctctgctagtcagaacagggcaactcgggcctgacctccagcttacgcagcctcaggattgtcacctggctgcacaggagcccacagaaataataaaaaccacatcatttataacatgtctcaatctcaacccatagggagagccctccaatatcaggtacacattgagctgaaggaaacaataaaatgcaatcaaataacaaggtgccattcctgactaataacacatagttgccagaagcatctgagattccattgtttagtactcaaagtgctcagaacaggtgaaattaaagagaggttgggggaagagtgggaataaaggcttttgaaagtctgaaccaaaagcaaatgttaatatttggaaaccttgctattcctacagatttatttctgactcctgag

SEQ ID NO: 1122 - DNA, 2130 bp, Homo sapiens
ggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggcaagctcaccccaagtagtgacaagaggaccaccagcagctccaggctgacatttcaccagcttagcagcccgtgtaggatgaaagtttctcctttgcaacagttcccacaaaagacccaggacctgacttgtactgtattggcccagattggatcatgtatccatttccaaaccaatctttgtgacctgggttggccaggcctggatcacatgctcatttctggactagagaagaggggaactcagccctactgaaatcgacaggacagattgtgggaaaggggttcatttcacaaaaggaaaatggtgggtctgtttccagaataagggtgaatagatgctgagtcccccaaaacaaaaattgtcccacatctcccgaacctctccagctagatgtcccacaggcaacctgtggcaaacccaacgtgattctccccagctctgagtctctacaactgtattcccgtgttgaagttatgatcgatgaactacttactcaatttgggaacttggggacagcccccaccatcttctgaagtgaactgatctgcccttttctcaacaatgccagtgctttcgccctgctttgggatttggcatctcttccccaagctgtttaactggattcctatctcgttactctgtctccattatctcctcctgcaaaccactcgccacatggctgctaaaatcatctttcccaagcattgatctgcccgtttcttccctgtgcatttattttttggctttccattgtcatgttatatttggggacctctccacactgtgagtcttggtggaaacagagtcttgacatgagcaagtaacccatgctccaccaggggaatgcactggccctagacctcaactctagggcttgtggcaaaaggatggtaagagaaggaatgatgtgttctgtggctctggcagcggcagctacatccagcttctggggtcagccagggcaatcatgccagctacgacatccagcatctagcaaggttaatggggtaagctgccgtttctggcctcggcagcatgaccatgggctccttccaggcctggttttgtggtatgacacggcctgaacctctggcttcagagcctctccttgtgtccctgtattttatccagcctgcttctccagccttctaggccagtccttgagatcctggtttcctctcaaacaattccttttgagcccatctcagccagaaccagctctgttgctcacagctataaaccttgactgagacactcctgtgtggtttcaggagaaaatttaaactcttcagccaggcataagagaccctttacgatctgagcctcactcacctgttccctggcccactgcccaccccacagccctaagtgattagcaaagcaggcctttcacatttacaggcctctgccctcctggcatccccttctccacctggtaaatgctgcccaactcaagcagcaactcctaccataatctttccccttctcccttctctcccagcagaacggtgggctcccctctctggttccctgcagccttgctctgcataggctctgatgaatgcctggcaccctatatctgtgtgtgtgtgtgtgtgtgtgtgtgtctgtgtgtgtgtgtgtgtgtgtgtgtgtctgtgtgtgtgtgtctgtgtgtcttgggagggtcatagagctcctcaaagcagcagcatgtcacctcccccacgccccacgtctttgtgcctcctaccctagagcccaccatagcacttgtcccatagtgagccctcaacaaacacacagttaacaaaggatggcaatcaatgctccatcctgccagccctggacacaacacccaacagttgctcgagggccagtgtggcattcttacttaataaaacatgttggaaaatg

SEQ ID NO: 1123 - DNA, 2415 bp, Homo sapiens
agcagcgtgtgtttctcccttgcctctgcggcggcggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggtaagccctttggcgatgcttccagccagcaatttgcctcctctgaggagtccctcaatttctagttgaaatgatcagtgtatcatgcctggattcaaattgggtttctttctgagtttgaaacttgtactgaaagccctgtgctttcagtggcacacacaggagagtatccaaaaccacacagtaaagtgtgtgatgctacgagtttccccaaacattggaaacaggaaggaaaatgaagtgaagccctggacttcgagggatgtgatggaattaagggataataggtttttgtactttaataatatgtattctgttattatttgctttcgaagctgctttttttccacttgtttattctatctagacttgctaagacactgagttgatatgccagcagtgcatgacactatcagcaacattcaaatgagagcttctggcctggcaggctggcactgtgcgtgcctctctgtgctcagaagttaaagctttgcaatccactaacactctattaaaaactagttaacattttaccagcccatggcctttgaaaatgcactctgggtggaagccataggtatgtctgatatgataacaaattgtatataaagctaaccaaaagacaattatatctgtttccctaggaggcgatggtaaactagacccactgtgtgaaaaggccaggatagccgtgctgaatgcctactgatctcctcatggaacaggcatctcaagtcggcacaacagcagctgccccagccattctatgatgcaggcagaagtggctgtgccacggtgtggacactgggctctgctagtcagaacagggcaactcgggcctgacctccagcttacgcagcctcaggattgtcacctggctgcacaggagcccacagaaataataaaaaccacatcatttataacatgtctcaatctcaacccatagggagagccctccaatatcaggtacacattgagctgaaggaaacaataaaatgcaatcaaataacaaggtgccattcctgactaataacacatagttgccagaagcatctgagattccattgtttagtactcaaagtgctcagaacaggtgaaattaaagagaggttgggggaagagtgggaataaaggcttttgaaagtctgaaccaaaagcaaatgttaatatttggaaaccttgctattcctacagatttatttctgactcctgagggaataaatattttaaattgctattataaaattagccaaaatcaaatcttcaatttctctcatctaaaacaagaaaatgacctgccttcttttgcattaatatcgtctgaggagggcgcaaaagagtcctcagcagaatgtgagatggttccctggtccctctggagtagaacacagccccatagagttaaagagggttttcactatgttcagtgtgaaaatcagtcatgtcgaaatgatatttttactttccactcttacgcaccaatgtgtagtatatattcttaactatagagtaacagagagggggaaatgcagatattgatctaatgacgtcaaatgggaggtcatggtaagaaggcctcacacctacggggagaaaaccagattccctaacagaaaactctggacccggggcacctgtgctgaaggagcagggctttcaggatcgctcagagacctgcggcttcacctgctctgagagcagtcctaaccatcgccccaggcagcctcaaaccctcctgcaccccagaacttcaaagaccactggggaccatgaaactgcttgcacaagttccttctcacacaggacaaagtaggggatataatttttaaaaccccagcccaagcttcacttgtcagagttgattcagggattgtgaatcacttagaactctatggaactatttaagcatctccttactgagaaactgaggctcaaaagagattcttcctcccagtgtctggtgctggttttcacatatcttttgtaaccctacatttagtccctttttttcaaaacccagtttaagttactatagatgtagcattcaatctttgtttcaatataacattttactacaagagaaatccattctcattaaagaaaaatggaaaaatacaggtaaaaataaagtacaactttagtaacattttt

SEQ ID NO: 1124 - DNA, 2090 bp, Homo sapiens
ggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggcaagctcaccccaagtagtgacaagaggaccaccagcagctccaggctgacatttcaccagcttagcagcccgtgtaggatgaaagtttctcctttgcaacagttcccacaaaagacccaggacctgacttgtactgtattggcccagattggatcatgtatccatttccaaaccaatctttgtgacctgggttggccaggcctggatcacatgctcatttctggactagagaagaggggaactcagccctactgaaatcgacaggacagattgtgggaaaggggttcatttcacaaaaggaaaatggtgggtctgtttccagaataagggtgaatagatgctgagtcccccaaaacaaaaattgtcccacatctcccgaacctctccagctagatgtcccacaggcaacctgtggcaaacccaacgtgattctccccagctctgagtctctacaactgtattcccgtgttgaagttatgatcgatgaactacttactcaatttgggaacttggggacagcccccaccatcttctgaagtgaactgatctgcccttttctcaacaatgccagtgctttcgccctgctttgggatttggcatctcttccccaagctgtttaactggattcctatctcgttactctgtctccattatctcctcctgcaaaccactcgccacatggctgctaaaatcatctttcccaagcattgatctgcccgtttcttccctgtgcatttattttttggctttccattgtcatgttatatttggggacctctccacactgtgagtcttggtggaaacagagtcttgacatgagcaagtaacccatgctccaccaggggaatgcactggccctagacctcaactctagggcttgtggcaaaaggatggtaagagaaggaatgatgtgttctgtggctctggcagcggcagctacatccagcttctggggtcagccagggcaatcatgccagctacgacatccagcatctagcaaggttaatggggtaagctgccgtttctggcctcggcagcatgaccatgggctccttccaggcctggttttgtggtatgacacggcctgaacctctggcttcagagcctctccttgtgtccctgtattttatccagcctgcttctccagccttctaggccagtccttgagatcctggtttcctctcaaacaattccttttgagcccatctcagccagaaccagctctgttgctcacagctataaaccttgactgagacactcctgtgtggtttcaggagaaaatttaaactcttcagccaggcataagagaccctttacgatctgagcctcactcacctgttccctggcccactgcccaccccacagccctaagtgattagcaaagcaggcctttcacatttacaggcctctgccctcctggcatccccttctccacctggtaaatgctgcccaactcaagcagcaactcctaccataatctttccccttctcccttctctcccagcagaacggtgggctcccctctctggttccctgcagccttgctctgcataggctctgatgaatgcctggcaccctatatctgtgtgtgtgtgtgtgtgtgtgtgtgtgtctgtgtgtcttgggagggtcatagagctcctcaaagcagcagcatgtcacctcccccacgccccacgtctttgtgcctcctaccctagagcccaccatagcacttgtcccatagtgagccctcaacaaacacacagttaacaaaggatggcaatcaatgctccatcctgccagccctggacacaacacccaacagttgctcgagggccagtgtggcattcttacttaataaaacatgttggaaaatg

SEQ ID NO: 1125 - DNA, 2513 bp, Homo sapiens
aaatggtgccagacgtggtggtatgagcctgtaattccagccactcaggaggctgaggtgggaggatcactctggcctaggagtttgagatcagcctgggtgacagagcaagaccctgtctctagaaaagagaaagaataaatggctgatggagatgactctactgcaaaaatgacaaccagcaagaaagcgggtggtgcccgtttcctccctggggaccctcagagggccaggccattctcttccttggtgtgactgcggatccagggcccagctgaagagcatcagatctgtgggcatgttgcaccagtgaatgttggagaagtacttgttggacacacatgttcctccatttagacagtcacagttcgctggagagaacaaagccaactgttgtaggggtggatactcacatggaacttgatgaagttcattgctgccctggaagagattcgggaggaggcttcatcaaaggtcccatgctccagggactccagggtgagggtaaactggccccaatcccaaaacccactcttccctctccctctcgcctcaccctgttcgtatctagttctcaaatggaagaccatgggtttccagccaggagaaatggattgacccaagcaagcttcatctaccagatgcccgcaggctggggcagtcccggcggcctcttcctcccttgccagccagtgccaacccccgtggttctcaagcctccgctgccaccctgtcccatttcctggggagagtctggccctgctgtggatggaatccggaggaccccagctccctgagcagcccctcctctcccctggtgctgatcagaggtccttgggcagcatcagtcaaagcaagagcgcactcactttggagtcgctcacgaccaggacgcagagaagcaggcgcgccagcagggctctcatggtggcgaggtcggggcgctagacggcggctctgcaaaggaaggagaagtcagggcaagaggcggaggaacgggaaggcaggccaggcgggcgactgcagcgcaggggagatgcccgcggtgaccaggctccccagctgtctctctcctctctgggctccggactccgggcagcctggatcggcacccgcgggggacgcccgggacggggcgccttgactccgtgcagccgccggggagcccagggagcccgggcagcccagggcgggggaggcagacgctcgggagctggggccgccgcgcatccggcccggggatctcaggaccgcggcactcaccggtggctgcggcaggagggcgcgagccggcgctgcggggacaggtggaccctggcccgggctccggggctgcggtctccgcactgtgctgcgacccgcggcgcctgctctatatcagggcccgccccggcgccgcccctccctctcccgcccggctccctcccctgtcttgcagcgctcagcgacccggaccccgcgtgcttccgcaacgctcacaaagatttgggggaagcgcgatctccagcggaggggacccaacagcgtctggactgaggaatcgagaggcttgtaaattctccgtgcttcctcccatgcacctggccgggggcctgccccagtgcaaggagtccccgaattgcagagaggagagaaggcgcacaggagactctctacctcgcccagctctgaagcctcctggggtcctctaatcagttcttctgcaacttctccccgctgggccccaacttgcctaagactgcctcagacccccttgcccgcagctgatggagctgtgaagtcttcatcaacgcgacaaatgtacgagacatactctcccagaagcacagacagaaaaacccctgcctgtaggggctccctctgtgcgtctgttcagtggcagtccccagatatcaccaacacaaccagtggatggaacaaagccgggcttattgctttcggcagtaagggggtttgtttgatggtgctatcagagggggaaaggcaaggccagattactgaaaatttgcagcttggtttaaagtccgtttttgacagggcttgataaggattgggttaggtgtcgtgatatgatgttacaggattgtgggaacaaagtcctagggcataaactgttggtgcttcctattgaagtgttaacgggtcttttgggaagtttccataatgagcaattcatttatttgtgcaggcaagaataaaagtaaagacaatggaaacatgtagacagttctaactgtggaggttctggagggtgtggaagttctgttctcacctctgagtagaggaattgggagactggaggacaaaataagaggaagatttatttttcactgtttgtccttttacactcttaacattttaaaaagcacatctctgtatagcccattccaaaaagataattatgcattttttaatgcatgtgtatttagtgttttacttcatcatagagccttgtttattctattcagatagaaacaattgtttatcaaataaaattgtcctccagaaaaaca

SEQ ID NO: 1126 - DNA, 2360 bp, Homo sapiens
gctgatggagatgactctactgcaaaaatgacaaccagcaagaaagcgggtggtgcccgtttcctccctggggaccctcagagggccaggccattctcttccttggtgtgactgcggatccagggcccagctgaagagcatcagatctgtgggcatgttgcaccagtgaatgttggagaagtacttgttggacacacatgttcctccatttagacagtcacagttcgctggagagaacaaagccaactgttgtaggggtggatactcacatggaacttgatgaagttcattgctgccctggaagagattcgggaggaggcttcatcaaaggtcccatgctccagggactccagggtgagggtaaactggccccaatcccaaaacccactcttccctctccctctcgcctcaccctgttcgtatctagttctcaaatggaagaccatgggtttccagccaggagaaatggattgacccaagcaagcttcatctaccagatgcccgcaggctggggcagtcccggcggcctcttcctcccttgccagccagtgccaacccccgtggttctcaagcctccgctgccaccctgtcccatttcctggggagagtctggccctgctgtggatggaatccggaggaccccagctccctgagcagcccctcctctcccctggtgctgatcagaggtccttgggcagcatcagtcaaagcaagagcgcactcactttggagtcgctcacgaccaggacgcagagaagcaggcgcgccagcagggctctcatggtggcgaggtcggggcgctagacggcggctctgcaaaggaaggagaagtcagggcaagaggcggaggaacgggaaggcaggccaggcgggcgactgcagcgcaggggagatgcccgcggtgaccaggctccccagctgtctctctcctctctgggctccggactccgggcagcctggatcggcacccgcgggggacgcccgggacggggcgccttgactccgtgcagccgccggggagcccagggagcccgggcagcccagggcgggggaggcagacgctcgggagctggggccgccgcgcatccggcccggggatctcaggaccgcggcactcaccggtggctgcggcaggagggcgcgagccggcgctgcggggacaggtggaccctggcccgggctccggggctgcggtctccgcactgtgctgcgacccgcggcgcctgctctatatcagggcccgccccggcgccgcccctccctctcccgcccggctccctcccctgtcttgcagcgctcagcgacccggaccccgcgtgcttccgcaacgctcacaaagatttgggggaagcgcgatctccagcggaggggacccaacagcgtctggactgaggaatcgagaggcttgtaaattctccgtgcttcctcccatgcacctggccgggggcctgccccagtgcaaggagtccccgaattgcagagaggagagaaggcgcacaggagactctctacctcgcccagctctgaagcctcctggggtcctctaatcagttcttctgcaacttctccccgctgggccccaacttgcctaagactgcctcagacccccttgcccgcagctgatggagctgtgaagtcttcatcaacgcgacaaatgtacgagacatactctcccagaagcacagacagaaaaacccctgcctgtaggggctccctctgtgcgtctgttcagtggcagtccccagatatcaccaacacaaccagtggatggaacaaagccgggcttattgctttcggcagtaagggggtttgtttgatggtgctatcagagggggaaaggcaaggccagattactgaaaatttgcagcttggtttaaagtccgtttttgacagggcttgataaggattgggttaggtgtcgtgatatgatgttacaggattgtgggaacaaagtcctagggcataaactgttggtgcttcctattgaagtgttaacgggtcttttgggaagtttccataatgagcaattcatttatttgtgcaggcaagaataaaagtaaagacaatggaaacatgtagacagttctaactgtggaggttctggagggtgtggaagttctgttctcacctctgagtagaggaattgggagactggaggacaaaataagaggaagatttatttttcactgtttgtccttttacactcttaacattttaaaaagcacatctctgtatagcccattccaaaaagataattatgcattttttaatgcatgtgtatttagtgttttacttcatcatagagccttgtttattctattcagatagaaacaattgtttatcaaataaaattgtcctcc

SEQ ID NO: 1127 - DNA, 2799 bp, Homo sapiens
attttgtccaggaacgcctacgtttgtggcaggtggagacagcttattaggcagcctgctctcctcttatgatggccttggtccgggatcgcagggctcattatgtcatgagcatagttattagatgggttcactgcttttcctcctccttgagggggacctttggcacacgctgggaggccatgaaagccaaggccaccgagctgcgggtctgctgcgcgcgtaggaagcgagaagctcgggaattcaagcccccgcaaatgcgcgggtccacgagacttaacatttcagatgatttaaagattggctttttcagcacagaccatgccactcaaactgattccagtgaaatactgtcagtaaaagaattgagttcatctacgcaaaagttagcacagatgatgaaatccctccaggtagattttgggttcctcaaacaattgcttcagttgaagtttgaggaccgactgaaagaggaatctttgagtctcttcaccattctgcatgacaggatcctagaaattgaaaagcattatcaacagaatgaggataagatgagaaaatccttcaatcagcagttagctgatgccatagctgttatcaaaggaatgtaccagccactgtgaaaccaaacattgagatactctggatgtgctgaaggtagcaaggtggaaagataagaagcagaggggtccttggtaatgtcatggagccatgaaagtaaccctggacttgccctgcctctggcctcttattcatgagataacaacccctcagtgtctaagccactgttagttggcttttcagttacttgcagctgaaaacatcccaggacagattgctctgctaacgatctctgtgactctgtgccaaactgtgtttccaaaggcatctgtgacactgtctcccacttacctgctcttgtgcaatgtttctctcccatcaagaggtggaatctgattcccctcccttgaatcagggctgcccttagtgacttgctgataaacacagaatgtggaggaagtgaagctgcgtgacttttaagttaacgtcaaaagaagtcttgcaagttcatccttattcactctgaatgtttcccctctacattgtccctccctgaattgagctaccatgctgacaaaagcccatgccatatggaagatctacatgtaggtactactgggtctccaggctcatctgagcccagcctttgagtcaccccagcccaggagtcaaaaatatgagtggagaagcgtccagatgactccagctgccagccatgtagactctttttatgtgaggtcacaggtcttacagaggagagataggccatccctgctgtgcttctactaattcccgactcattgaatttgttttttttttttctttgttttgctttttatttttgggtctttttttttttttttttttttttagagacagggatctcactgtctcccaggctggaatgtagggtgtgctcatagctcactgtagccttaaacttctggactcaagtgatcctctggcctcagcctcctgagtagctgggactacaggcatgtaccagcacacccagttaatttaaatatatatatatatatgacatgggatcttgctatgttatccaggctggtcttgaactcctgtcctcaagtaatcctcctgccttagcattccagagtgctaagattacaaccatgagccactgtgctggcctaattaatatttaatggaagaagacggaaggaagaaagagaaagagggaaggagggaaaatgagcattatctgtagcagttttatatatattgattttgtaaccaaaaatcttgctaaattcttgtgtttattttaataagttttctatagactctttggggctttctatgtaaacagttatgcaactgagaataaatattttttgtcacttcatttttcatccataaaccatgtaatcatttcagcagtggcctgtctggagcagctgctgcaaagatgccggctgcagcaggggagatatggccagggctgtacactctactaagctggcaggagccaggaacaagcaggagtggtgctcaccttctgagttggtgatgggggagctccacgctcctagaggcagctgcagctgcccagccatggctgcagacccaggcatccctgtgctcttgggggcctaggaagcccccctgctcccacaggctcggaagtgcctactcctgctgcctggcctctcctcactcctggcacccactctgattttgaagcaaagttgtggccaagcccaggcgctgttatgacccagccaggtgtgtgtgtgcttgggatggtgctgacacaccagccctctgctgccttggccccctccagagtttgggtgccaacaagcatgggagggaggccaagggggcactgagggtggcacagcacaggcctgcaggtgtcccttggcatgaacagcctgggcaccatgaacagcagcaggaagcgacaggctcccgagtggaaagggatgtgtcgctggtgaagctccaccttcaacccaggggtggcctgaagcctgggggccaggctgccagttccacagactggagtgagaacttatggtgcttttttcaggcccacctatggctgcccattgaccaatcagcatgagcttcctcccctctgaagcccataaaaaccctagactcagccagactctggcagaagtggggatgacctgcctgcagagaggagttattcgctgtggggtcttctctcagctaagagctgaacagatatcaggatgacct

SEQ ID NO: 1128 - DNA, 888 bp, Homo sapiens
ggccggaagatcatggagggcctcgaggcctctattgaacaattccagttcaaccccagacttaacatttcagatgatttaaagattggctttttcagcacagaccatgccactcaaactgattccagtgaaatactgtcagtaaaagaattgagttcatctacgcaaaagttagcacagatgatgaaatccctccaggtagattttgggttcctcaaacaattgcttcagttgaagtttgaggaccgactgaaagaggaatctttgagtctcttcaccattctgcatgacaggatcctagaaattgaaaagcattatcaacagaatgaggataagatgagaaaatccttcaatcagcagttagctgatgccatagctgttatcaaaggaatgtaccagcaattctttgaggtagaagaagagaatgtttctttgcaagatgcgagtactgtcaaaacaaatattttgttaagaaaactgaaagagaaagaagaagttattaaagaattaaaagaagaactagaccaatataaagattttggatttcacaaaatggaatcttttgccaaagaaaccagctctccaaaatcaaacctagaaaaggaaaatttggagtacaaagtggaaaatgagaggctgcttcagatcatttcagagcttgaagaagaaatccagatcaatctaaaagaaaattcaggattagaagatgaacttataagtatgaaagagatggcagaaaaggatcacaaaactattcaaaagttaatggatagtagagacagattaagagaagagcttcattatgaaaaatcattagttcaggatgtgattaataaacagaaagaggacaaggaaatgagaaaaaagtatggcagcttaagtgtaaag

SEQ ID NO: 1129 - DNA, 2729 bp, Homo sapiens
acttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagctcagagaagaaacgatctagccctgctatttcagatctttcacagatccttaagtctcaagatgaatcagcatttttagagagttcaaatgaagtttcagttgctgaaaaccaatcctataaatctccatcagagacccatgataaatcacttacaacagtatcatccagcaaagaagttcaagattcactgtctgttggaacattggctcaaaaaaacgaaacagtgatatcaccattcattttacctcctgttcttacagaaagtaaaaaggctgatgtttcagaagaacaattacaaaagatgactgaagaacaaacttaccaagcagcagaaaaatctcaagctcataatgaagtaccaaatgaaaggcttgtagttgagcatcaagaatcattgtcaaaaaccaaattacaaataaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcttgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaaatgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaacgaagaaacttcaagctaaagtaacttcaagaaaaaagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatggagagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacagttggaaaacctacctataaagtgttacatgctgctgcccgaaaatctgtaccacacccatacttttgagaatgaaggaaattctgagcaagataagcaacatgacaaattcagaaatgcaggaaaggaaattgcaagtatagaagccttttgaaaataatactgactcgtgtggatggtgcttattgaaaaacagctggaaatacagtggatcaacagggtaggcccagatcacagaaggcctgaccaggcagtgaatgtgtctttaccatatggaacaattttgaacttctaagatcaagcctttttgttgctgagggtaagaaaggagctctgtgatgaggttccagcttacttctattcgccagtgtccctgtaatgctttctggtgtgatgtaaaatcaattaaacaaaacttgtgctctgcatgttttgaaa

SEQ ID NO: 1130 - DNA, 2079 bp, Homo sapiens
atgactgaagaacaaacttaccaagcagcagaaaaatctcaagctcataatgaagtaccaaatgaaaggcttgtagttgagcatcaagaatcattgtcaaaaaccaaattacaaataaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcttgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaaatgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaacgaagaaacttcaagctaaagtaacttcaagaaaaattaaaaatgaagcagcctcagaacttccagatacagcagaaaatcttccagcaatgtacccgtcaattagcgacctaataattcaatttgatttaaacaaagtggtcgagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatggagagactgataaggaacacttagcagatgatactggaagaggtataataaagggatcaatcaatgcacaactaaagggtcaccaaaagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacagttggaaaacctacctataaagtgttacatgctgctgcccgaaaatctgtaccacacccatacttttga

SEQ ID NO: 1131 - DNA, 1975 bp, Homo sapiens
gctcataatgaagtaccaaatgaaaggcttgtagttgagcatcaagaatcattgtcaaaaaccaaattacaaataaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaaatgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaacgaagaaacttcaagctaaagtaacttcaagaaaaaagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatggagagactgataaggaacacttagcagatgatactggaagaggtataataaagggatcaatcaatgcacaactaaagggtcaccaaaagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacagttggaaaacctacctataaagtgttacatgctgctgcccgaaaatctgtaccacacccatacttttgagaatgaaggaaattctgagcaagataagcaacatgacaaattcagaaatgcaggaaaggaaattgcaagtatagaagccttttgaaaataatactgactcgtgtggatggtgcttattgaaaaacagctggaaatacagtggatcaacagggtaggccca

SEQ ID NO: 1132 - DNA, 2975 bp, Homo sapiens
acttgacaccacgcgggtgttgcagtgcggactgtttgcctcttccccaccaagaacaccatttggtttcccccggctgggtctctatttagatgggcagtgatgacaccaaatataagcataaaaagacgttttaaaactacagatcctgaaacccagcacggcaggcacctgcagcttccagtgctgtaacagagaaaaaaaaaaatccccactttgcaattgcatctggtcaatgagaggctctagttttggggaagagggaaacacctaaccttgacagaatcatcaccagagacacctgccggctgacaaggacagctttcttggagccaacagatgatgcaaggaaataagaagtgcacagacgcgttcagcgactcctccagcatcggcagcgtgttggatgatgcagacagggaggtgagcagcctaacagaccgggcattccggagtttgtgcatctccgaggacacatccttccatgactcctatctggctgtgtccccggatatcacccgacaggtgtttgggacttttcaccagagaacagtgggccacacccagaggaaaagtggcatttggagccagttaccgtcacagggcacggaacattcgggctgggcggccaccttccaacagctacccaagtacgttcagggagaggaaaagtaccccaaaaccagccccccaccaacgccagtccagaggagactggaggtgccagtttccggcctaaggagcagcaataagcctgtctccaaagtatcaacactaattaaatctttcgacaggaccgagagccaacgttgtgagagcaggcccactgccagcaagcctccggctctgaaaaatcctcccaaattcgctcctcttccagaaaacagtgtcaacttctgcttcgattctgcctttctgacagtcaggagggtgcccgctgaagtttccaacacccatcagaacagctaccagccaggcaggaagcacggagaacaggagtcctccaagaatccagaaatggcctgtcacggctccagcagcttcctcccagcagccaatgacacggccaccttatgtgagtcaaagttcccctctccacaccacaagccagtcacgggtgagcctgggagaggcaaaggtacctttctgcacagtgaaaatagtgcttttgagtcatggaatgcccaccaaccaaagctgctggagagaaaggacacagctggaaccgtcccagaaagcaaagctcccaagcactatggggacacgaccttgctaagagaaccctgtcctcctgagcgcacagtctctccctgccaggtccaggccagctgcagtcaggaagagaacagacttgcagcaggggctctgtccacatctataccctgggggtgcagggatccaggagcccaggtatttgctgtggaaggaaaagctcccagctcacaacctgattctcaagagaagccagcccagcccccatggaggaagccaaagactggcaaaaaagggaaagaaagtctacaagatactttagaagaaaagacacagaccaaccagagaggcccacctttgtatacaaaacacaacccccaggaacagttttcagaaaacaatgctcttgacctgcctgtggaacccaatgaacattatgatcccccctttaacatcagtaagctcctgacccccatcatacccagcaagcacgccctggattcagcagacagccagccagcagagcgaaccccatcacccccaggacagctaaacggataccaagagaaggagcccagtgaatgtcagtctcgagacagctacaagtccaaagcccctagcctgctgttcaacctcaaggacgtgcggaagcgtgttaagagcacatacagttcctcacctctcttgaaagtgcttgatgagaaaactagaggtaaggttgatggaaagcaagaacctgtgagcaacggtgtcatcctccccaatgggcttgaggaaagccctccaaatgagctttctaaggagagacccgctgatgaccccactgcatcacacatcaatccccagaaggaccctacagctgaccccagtgagccctctgcagacagctatctaactcttagcacagctccgactatcgccaaagcccccttctatgtcaatggggaggctgctgagagaagcagttatgagaacaaggaggtggaaggagagttggagatgggtcctgccggatccagctggtgtccagactccagggaacaccgccccaggaaacacctctccctgaggctttgcaatagggatcctgagcctggaggggctacagagaaaatgaagacccaccagctagagaatgggctctccagatctgtgtcccaagagacagaacctgagagggaagcaggacttcagaacacacacacacacacacacacacacacacacacacacgatcatcaacacatacttagcctttttagatccataaagtccagaaggcagtagggatcccaagacgacctcacccaaagggctccctggctctcctctgatggaggggcactgcttgcttggcccggtcccctccgtgccagttcccaggcgcactctactccagcccttctccctccctcccttcctccctctcctggcccaccctgctcttccctcgccctgcaaattaggtgggtgtggcaagggcaccgcctggtcccaagtgtccctctgtacccacacccacccactcacttgtaagctccttgatgagcaaacccctaaggcccccagctcagactcagcaggcattcaggtcaactcaggcagactggctaaggaccagcccagggcaattttgcagaaatgatcatttgcacagaatgggtttccttcacagggagaaacttgcctctgaaagctattttctgatcaagaaaaggcccactttttaaaaagtgaaacaagtttgcagatacggttctctt

SEQ ID NO: 1133 - DNA, 5230 bp, Homo sapiens
aagaacaccatttggtttcccccggctgggtctctatttagatgggcagtgatgacaccaaatataagcataaaaagacgttttaaaactacagatcctgaaacccagcacggcaggcacctgcagcttccagtgctgtaacagagaaaaaaaaaaatccccactttgcaattgcatctggtcaatgagaggctctagttttggggaagagggaaacacctaaccttgacagaatcatcaccagagacacctgccggctgacaaggacagctttcttggagccaacagatgatgcaaggaaataagaagtgcacagacgcgttcagcgactcctccagcatcggcagcgtgttggatgatgcagacagggaggtgagcagcctaacagaccgggcattccggagtttgtgcatctccgaggacacatccttccatgactcctatctggctgtgtccccggatatcacccgacaggtgtttgggacttttcaccagagaacagtgggccacacccagaggaaaagtggcatttggagccagttaccgtcacagggcacggaacattcgggctgggcggccaccttccaacagctacccaagtacgttcagggagaggaaaagtaccccaaaaccagccccccaccaacgccagtccagaggagactggaggtgccagtttccggcctaaggagcagcaataagcctgtctccaaagtatcaacactaattaaatctttcgacaggaccgagagccaacgttgtgagagcaggcccactgccagcaagcctccggctctgaaaaatcctcccaaattcgctcctcttccagaaaacagtgtcaacttctgcttcgattctgcctttctgacagtcaggagggtgcccgctgaagtttccaacacccatcagaacagctaccagccaggcaggaagcacggagaacaggagtcctccaagaatccagaaatggcctgtcacggctccagcagcttcctcccagcagccaatgacacggccaccttatgtgagtcaaagttcccctctccacaccacaagccagtcacgggtgagcctgggagaggcaaaggtacctttctgcacagtgaaaatagtgcttttgagtcatggaatgcccaccaaccaaagctgctggagagaaaggacacagctggaaccgtcccagaaagcaaagctcccaagcactatggggacacgaccttgctaagagaaccctgtcctcctgagcgcacagtctctccctgccaggtccaggccagctgcagtcaggaagagaacagacttgcagcaggggctctgtccacatctataccctgggggtgcagggatccaggagcccaggtatttgctgtggaaggaaaagctcccagctcacaacctgattctcaagagaagccagcccagcccccatggaggaagccaaagactggcaaaaaagggaaagaaagtctacaagatactttagaagaaaagacacagaccaaccagagaggcccacctttgtatacaaaacacaacccccaggaacagttttcagaaaacaatgctcttgacctgcctgtggaacccaatgaacattatgatcccccctttaacatcagtaagctcctgacccccatcatacccagcaagcacgccctggattcagcagacagccagccagcagagcgaaccccatcacccccaggacagctaaacggataccaagagaaggagcccagtgaatgtcagtctcgagacagctacaagtccaaagcccctagcctgctgttcaacctcaaggacgtgcggaagcgtgttaagagcacatacagttcctcacctctcttgaaagtgcttgatgagaaaactagaggtaaggttgatggaaagcaagaacctgtgagcaacggtgtcatcctccccaatgggcttgaggaaagccctccaaatgagctttctaaggagagacccgctgatgaccccactgcatcacacatcaatccccagaaggaccctacagctgaccccagtgagccctctgcagacagctatctaactcttagcacagctccgactatcgccaaagcccccttctatgtcaatggggaggctgctgagagaagcagttatgagaacaaggaggtggaaggagagttggagatgggtcctgccggatccagctggtgtccagactccagggaacaccgccccaggaaacacctctccctgaggctttgcaatagggatcctgagcctggaggggctacagagaaaatgaagacccaccagctagagaatgggctctccagatctgtgtcccaagagacagaacctgagagggaagcaggacttcagaacacacatttgaaccagaaattcttcccagggcccctctctcctgaggaggaagatgtgttttacagtgacagccaatccgattttatgccaagcctcaaaggtaaggccaaattcagcaccagctcttcagatcaatcctttgcctcatttgatgatcagcagaagatgtggtttactgagaaccagcgggaagacaggaggaaggatgtgagtgcaggtgacagtcagaaggatgagaaggagaatgtgatgcggaaggatgagctgcagtactgtgccttaagcaatgggcacgcatgcctggaaaaccgcagccagggggaagcattgcaaagagaaagggaaagtgtgtctggaggaagaaccaggaaggcatcagcagaggaagctaatttcagaggctcttggattggggaaaataagggcacaaccttttcacaggccaaagaccttactccctcaccatcttctgcttcaaacaggcacatgctgtttacgattaaagacaacaccctcagagctacccccgtaattaaacctatcatgctgcctctcctgaggaccatgtccttggaggactccctcagcagtggccacaaagaggaggaattgccaaggccagaatggggtgaggatcctgggttttgtgcccccgaaaaccaggacattcttggtacatcgacacccactaacacacggggcacacgtgtgaagtgcatggccaacgaggtcatggaggaccctgggcaggggtcgagcatggccaggatggaggcctctcagccagccccaaaggggaatttcccatctatgcctctggtgggagagggggaccgggtgaaggcaccaccagatgctgcacctggcctcgtggcaagcaattgcaagagcggttctgcagactcagggaagctggcagccccatggcacatccccaccattgctttacccgagggtgacatagaagaccagccacccccatggcagcccgaaaactgttgggaagagcaaacaccaggtttcaagagtcactttttgtccacacccagagcagggccccctggcagaagactggtccccagtgagagggcgaattcccccaaccccggctcccccggggagagcagtgcctgctcccctgctgccagcaacatttgggaggagtcttcccaggcccctggaggaccagagctgcttcccgaggagcctaatcaagccagcccctgggccagctccagtcctgccagggtcacccggagggaggacctgacccacgccctcgtgtgggagggcggctctgaccccctacttgagctgtcggcagaagacctccggaccctctctccaagaggttcattgctggatgtggccaccagcccagcaggcacctctgggagacttgagcttcctgcacagctagagaggacagcaagcaagccacctgcagtcccacccaaaacagagaaagccctgcggcgggcaaagaagctggcaagtaagaggaggaagacggatcaggctcaggagaagcatggcgagtcacaggagggaaagccctgcccggaggacttggagcagacacagcaaaggccgctgtgccccagagagaggccccgacacaatttccccgtggtccgttccctgccccctcccgtgcaccgccactccgtgtccggcttctcggagcctgtcgggaggcggcccgggggcccccagtccctcacacccctgcccgcgtaccccgccacccagaaggtcctccaggatccgcagtccggggagtactttgtcttcgacttgccactccaggtgaaaatcaagaccttctatgacccagagacgggcaagtatgtcaaggtctccatcccgtcctccgagggggcctccccagagccgcccccaccggacgccctggccgctccctatgtgctgtaccccggcttccagccagtgcccgtgacggccttgatgccgctgcgctgctcctctcagctctccgcgcccaccttcctcaggcagggccctcgtgcctccgcggcccgcgccaggacccagagtgtccacgagtctggactacagctggacccagggcctcacggtgactgcaccccgcactctgcaggccagcgccctcatggtcctccccagagcccaggagaggagggtgtagaagctccaggcctgggcatcatctccactgatgacctagaggactttgccacagaaggcatttcttgagttactgcaggctgtcccccacccccagatgaacccagaggagcttacttccccctcccccaaaacaagcaacacacacacacacacacacacacacacacacacacacgatcatcaacacatacttagcctttttagatccataaagtccagaaggcagtagggatcccaagacgacctcacccaaagggctccctggctctcctctgatggaggggcactgcttgcttggcccggtcccctccgtgccagttcccaggcgcactctactccagcccttctccctccctcccttcctccctctcctggcccaccctgctcttccctcgccctgcaaattaggtgggtgtggcaagggcaccgcctggtcccaagtgtccctctgtacccacacccacccactcacttgtaagctccttgatgagcaaacccctaaggcccccagctcagactcagcaggcattcaggtcaactcaggcagactggctaaggaccagcccagggcaattttgcagaaatgatcatttgcacagaatgggtttccttcacagggagaaacttgcctctgaaagctattttctgatcaagaaaaggcccactttttaaaaagtgaaacaagtttgcagatacggtt

SEQ ID NO: 1134 - DNA, 2652 bp, Homo sapiens
gaagcctatgagacacaggaagaaggcagcagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgtttatcacatatggcgacacatttctgccaacccccagcagctatgatgaactttactatgagattatccgcatgcaccagagctttgacaacctctactccatggagccatcatcaaccactttaaccccaaaattgagtcctacgctgctgtgaatcacatatcccaactgtcagaggagcaggtgctggaggtggtgagagccaactatgacacgctcacgctgaagctgcaggatggcctggaccagtatgagcgctactcagagcagcacaaggaagctgccttcttcaaagagctggttcgatccattagcaccaacgtccggagaaacctggccttccacacactcagccaagaagtcctgctcaaggagttctccactatctcctgaggccacgcctacctgagcagcctctgactgcccttacccatgaggatcatgggctggagggggagcgaggggagagggggctgcccccgaggttggagagaaacacagataccaagttctcttggtgaagaccgcacttcaatggagcttgggcagcaggggcaggagggtcaagccagggataatcttatttggggaggaatgggtgggcacagtggggagaggcctccaggaatgtggggacttccagagtgggctccctaaacagcccctcacatttccaatcttgaggttacaagctgtagctactgactaattttcgggagctggtgaggcaagcctcagggtaatgccagcaccctgaaagtcagtggctctgctcggcttctgaaaacagatcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaactttctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcgagatcctccctttttaaagcactttctaaagccctcaggatggcgggagcaaacagcactggtatattctaggagtaagtgcaggaattcagcagtgagagcatgtctgggaccacctggactgccatccatttaacctcaaatctctttgggatactcgccctccctgggaaccagagttctggctctaacattgagcagctatgcactagttccagagaagccactaacaggctgccatgtgtagatgtaggttcttaagagatcacaggctgggtcatctgatcactggatggatagctcagcctggggcatttagtgttttccctggtgataaatccccaaggcagctggatttggagctggtggcaagttgaaattattaaaaattgatttgtgtgggactgtc

SEQ ID NO: 1135 - DNA, 3403 bp, Homo sapiens
aagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaagggtaatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcatgaaggcaagattcccaagggagatgtgatagctgatcaggcttcccagacacctccttcccaaacacctccttcccaacacctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacacctccttcccaacacctccttcccaaacccctctttcccaaacacctccttccccaacacctccttcccaacacctccttcccccttccccaacacctccttccccaacacctccttcccaacacctccttcccaaacccctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctctttcccaaacacctccttccccaacacctccttccccaacacctccttcccaacacctccttcccccttccccaacaactccttccccaacacctccttcccaaacatccccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacatgctgatacggtttggatctgtgtccctaacaaatcccatgtcgagctgtggtccccggtgttggagatggagcctggtgggaggcagctggatcgtgaggtcgtgggggtggagttctcacgaaggagttagcatcatccccttggcgctgttctcgtgatagtaagttctcgtgagatctggttgtttaaaagtgtgcagcacctctccgctcactctcttcctcctgctcctgccgtgtaagatgcctgctctgtctgccacaagtgaaagcttcctgaggtctccccggaagcagatgctgccacgcttcctgtacagcctgcagaactgtggaccaatcaaacctcttttcttataaattacctggtcttggggatttctttatttaatgtgagaacgcatgcccttttggatctgctgtttctacttttataaatttatcatgcagaaatacacaaatacacaaagatacatgtaaaaaaagtagtttactgcagtactgtttgtaataataaaaaatcaggctggacgtggtggttcatgcctataattccaaccctttgggaggccgggacaggtggatcacctgaggtctggagctcgagaacaacctgaccaacatggagaaaccctgtctctactaaaaatacaaaactagctgggcattgtggcacatgcctgcaatcccagctacttgagaggctggggcaggagaatcactagaaccgggaggcggaagttgcagtgagccaagatcatgccattgcactccagcctgggcaacaagaggaaaacccagtctcaaaaaaaaaaaaaaaatcatgtgggtattgcttaattctgatttcatatcattgaacactgtagatattaaaatgttcagcaggcacagttctgtaaaattgttcgtgatacattaagaatgaaagaatcaagttgtataataaggataacatcatcccacttttgtacaaataaatgtttggtgtttgtgtgta

SEQ ID NO: 1136 - DNA, 3249 bp, Homo sapiens
attattaatgtgtttgctttcatttttggtgctaggcagctgggacaccaaggagagttctgtggcaagccacaagtatgaaggcccagaacttcccctgagggcatagcttccatttcagtttggggcaagaataaaatctgctcaaggatattagtttgggaacttcctggtggttcagatttcaagcagagtttgtgcttaatcctcacccaggcaccaaggctcagagtcagcaggagtgagttcaggaatcctcgggacaaggcactttcctgagcactggaccagcgacctcttggcttccagggaggacacacagccatcatggaacccaaacctcagaagagtccaggcaaacaatttacattttcttatgaaaatgaagtctgcaaacaagattactttattaaatcaccaccttctcagctgttctcctctgtgacctcttggaaaaagcggtttttcatcctgtcaaaggctggggaaaagagctttagtctttcctattataaagaccatcatcaccgaggttccattgaaattgatcaaaattccagtgtagaagttggcataagtagccaggaaaagatgcaatctgtgcagaagatgtttaaatgccaccctgatgaggtcatgtccatcagaaccactaacagggaatacttcctcattggccacgacagggagaagattaaagactgggtctccttcatgtcatcatttcgccaggatataaaagcaacacagcagaacacagaggaggaactctcattgggtaataaaagaaccctcttctactccagccctctccttggcccttccagcacatcagaggctgttggctccagctcaccaagaaatggtctccaagacaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaaggggtcggcctcactaactgttgtgcaattgtctatattaatcaataatatccccgatgaaagccaagtggagaaactgaacgttttcctttctcctcctgatgtcatcaactatcttgctctcacagaagccacaggacggatatgaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcatgaaggcaagattcccaagggagatgtgatagctgatcaggcttcccagacacctccttcccaaacacctccttcccaacacctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacacctccttcccaacacctccttcccaaacccctctttcccaaacacctccttccccaacacctccttcccaacacctccttcccccttccccaacacctccttccccaacacctccttcccaacacctccttcccaaacccctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctctttcccaaacacctccttccccaacacctccttccccaacacctccttcccaacacctccttcccccttccccaacaactccttccccaacacctccttcccaaacatccccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacatgctg

SEQ ID NO: 1137 - DNA, 2534 bp, Homo sapiens
gaaaaatatggagcaggaacaggaaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaaggggtcggcctcactaactgttgtgcaattgtctatattaatcaataatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcatgaaggcaagattcccaagggagatgtgatagctgatcaggcttcccagacacctccttcccaaacacctccttcccaacacctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacacctccttcccaacacctccttcccaaacccctctttcccaaacacctccttccccaacacctccttcccaacacctccttcccccttccccaacacctccttccccaacacctccttcccaacacctccttcccaaacccctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctctttcccaaacacctccttccccaacacctccttccccaacacctccttcccaacacctccttcccccttccccaacaactccttccccaacacctccttcccaaacatccccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacatgctga

SEQ ID NO: 1138 - DNA, 2046 bp, Homo sapiens
atgcctttaagtgcactaatcttttcttgtacaatatttaatctgctcttactcccatccagtgttgttgctgtttttttgagacattgtagttttcatctttaaaatttcactttaggtcttctttatatcttttatatctctccctaactttttgaaaatatagtgataataactgctttaattactttctctgccaattctaacatctgtgtcagttctaggcctgttttgattgattgactttcttctcattattgatcatgttttccttcctctttgtatgcctggtaaactttgattgactgccaaacatcgcaaattttaccttgttgtttcctgaatatctttgtattcctatgaatcttgagctttgttctgggatacagttaaattttttgggaacaactttcttctaagtctttcatgattttttaggtgggtttggagcagtgctcagtgtagaactagtaattagtgtagagctaattattcctcacactgaggcaagacattcctgagtactctacccaatgccctgtaaattataagtttttccagtatggctggaggcaaacaatttacattttcttatgaaaatgaagtctgcaaacaagattactttattaaatcaccaccttctcagctgttctcctctgtgacctcttggaaaaagcggtttttcatcctgtcaaaggctggggaaaagagctttagtctttcctattataaagaccatcatcaccgaggttccattgaaattgatcaaaattccagtgtagaagttggcataagtagccaggaaaagatgcaatctgtgcagaagatgtttaaatgccaccctgatgaggtcatgtccatcagaaccactaacagggaatacttcctcattggccacgacagggagaagattaaagactgggtctccttcatgtcatcatttcgccaggatataaaagcaacacagcagaacacagaggaggaactctcattgggtaataaaagaaccctcttctactccagccctctccttggcccttccagcacatcagaggctgttggctccagctcaccaagaaatggtctccaagacaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaagggtaatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggaggactctttcaggattctttcatatcaagtagcatttggagaaggcactgagctaagagacagagcacctgggttcaggacctcagatcggcatgatgtagcaaaaagagcttgcatggaatcagactggtgcagggattccaaaacagctccttcaaccaatttgtgcctcagttttcttttctgtaaaattatgactaatgatggtgctggttgttggataattaaatgaggtaatatgtgtaacgtgcttacaaaggtgactggcacatattaggtgctcaataaagctactagttacttttacttctactacaa

SEQ ID NO: 1139 - DNA, 1763 bp, Homo sapiens
agagtcagcaggagtgagttcaggaatcctcgggacaaggcactttcctgagcactggaccagcgacctcttggcttccagggaggacacacagccatcatggaacccaaacctcagaagagtccaggtacccgaggggtataatcgcagaagcagaaatctttttattgaaaatgccccacggtttccttcaagctaaccaggatacagaacttggtggtttttgtgcaaacaatttacattttcttatgaaaatgaagtctgcaaacaagattactttattaaatcaccaccttctcagctgttctcctctgtgacctcttggaaaaagcggtttttcatcctgtcaaaggctggggaaaagagctttagtctttcctattataaagaccatcatcaccgaggttccattgaaattgatcaaaattccagtgtagaagttggcataagtagccaggaaaagatgcaatctgtgcagaagatgtttaaatgccaccctgatgaggtcatgtccatcagaaccactaacagggaatacttcctcattggccacgacagggagaagattaaagactgggtctccttcatgtcatcatttcgccaggatataaaagcaacacagcagaacacagaggaggaactctcattgggtaataaaagaaccctcttctactccagccctctccttggcccttccagcacatcagaggctgttggctccagctcaccaagaaatggtctccaagacaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaagggtaatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaa

SEQ ID NO: 1140 - DNA, 679 bp, Homo sapiens
gcaagaacaaggctcaggaattgattggtgtctttcccctgccgatgtggaagcacagaccacaaatgaccaaaaggggtcggcctcactaactgttgtgcaattgtctatattaatcaataatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggaggactctttcaggattctttcatatcaagtagcatttggagaaggcactgagctaagagacagagcacctgggttcaggacctcagatcggcatgatgtagcaaaaagagcttgcatggaatcagactggtgcagggattccaaaacagctccttcaaccaatttgtgcctcagttttcttttctgtaaaattatgactaatgatggtgctggttgttggataattaaatgaggtaatatgtgtaacgtgcttacaaaggtgactggcacatattaggtgctcaataaagctactagttacttttacttctactacaactga

SEQ ID NO: 1141 - DNA, 994 bp, Homo sapiens
gggcagaggccaagtgggcaccggatagcgccagccccgcccagagagcgaaatcatggagccttccaagaccttcatgagaaacctgccaatcacaccaggctatagcggctttgtgccattcctcagctgccaaggaatgtccaaggaggatgacatgaaccactgtgtgaaaaccttccaggagaaaacacagcgctataaagaacagctgcgggaattgtgctgcgcagtggccactgccccgaaactgaaacctgtcaactccgaggagacggtcctgcaggccctgcaccagtacaatctgcagtaccaccccctgatcctggaatgcaaatatgtaaagaaacctctccaggagcccccgatccctggctgggcaggctacctgccgagagccaaggtcactgaatttggctgtggcacgagatacactgtcatggccaaaaactgctacaaggacttcctggagatcacggagagggccaagaaggcacatctgaaaccatatgaagagtgaggagaaatgtctctttccttcctactaccgttttaaaaaggggatgaaatgtttgcagtggcctttctgcttagctgggccagctccctgcaactcacacggacggttcctctcctagatggaagctgccctgcccttggaaggcccctgagagaggaccccaaaactccgctgacatgtggctgtgctcagaggccaagtataccatgcagtgggaagatgtatctagagccactgtcctccgcaaagtatgcagaaggctagaagcgcagagtctcccaaggaggtgaactttaagtggggcttccaaaacctgccattctcatgttggaatcacgcccagtgagcaataaagaaatttagtaacaagaattttttaactgccgcctgcatcctgagtggttgacggttgcatgtcattaatgataaagaccgttttttgtcatgtgggaataaagaggctgcttctccgca

SEQ ID NO: 1142 - DNA, 745 bp, Homo sapiens
gggcagaggccaagtgggcaccggatagcgccagccccgcccagagagcgaaatcatggagccttccaagaccttcatgagaaacctgccaatcacaccaggctatagcggctttgtgccattcctcagctgccaaggaatgtccaaggaggatgacatgaaccactgtgtgaaaaccttccaggagaaaacacagcgctataaagaacagctgcgggaattgtgctgcgcagtggccactgccccgaaactgaaacctgtcaactccgaggagacggtcctgcaggccctgcaccagtacaatctgcagtaccaccccctgatcctggaatgcaaatatgtaaagaaacctctccaggagcccccgatccctggctgggcaggctacctgccgagagccaaggtcactgaatttggctgtggcacgagatacactgtcatggccaaaaactgctacaaggacttcctggagatcacggagagggccaagaaggcacatctgaaaccatatgaagaaatatatggagttagctccacaaaaacttctgctccgtctccaaaagttttgcagcatgaagagctgctgccaaaatatcccgatttttctattccagatggaagctgccctgcccttggaaggcccctgagagaggaccccaaaactccgctgacatgtggctgtgctcagaggccaagtataccatgcagtgggaagatgtatctagagccactgtcctccgcaaag

SEQ ID NO: 1143 - DNA, 1909 bp, Homo sapiens
ctgtggtgtagctttgctgtctcctgtgtcaatgtcaggaggacaggctgagctcctgggaccagaacccctcagattccaggaggagcagagaaagcacagatggcctggagagtcccaggggtgaggccagcaagtactttcttcccccaggtgctcagagcatcctctgagttgccaaacagactcccagaggggtcaactgtgggccctaaaccagacagcagctgggaagcaggctctcaggggaactggggtctcaccagctcaggagcaggccaggactcctcagcacagaagctgggaatcttgagtgtccagatcagcctgaaaatctggacttgggaaaagccatctggctggggccacctgcatgccgctgtgactggggcatcctgctgctctcctctctcacaaggtggtgccatctgccttgtcactgctcctcaggacaagcctgactgctctccctgcacctctggccattgagaatccggctgctccatcgtggtggaaaatcttccatgctcagagggacaccttccgacactggggttctggagagcctggtgccacgagacaaggagccatgtgacaagagggggaggggtaggagtgggagacacaagtgtggtttgggacaaaatagggcctgaggctcacgtgttataaaaccccctttgctctgcctgtctccttgaattgtggccagtttcacatgggaagcaacgtcgagggacagggagactgcaggtgaggcctcagggctctgcattcccatccccaaaagtcaccagcgtgtggccttgtgggtgtcactcccctctgtggagtcaactttgtgcagtgacatgcagaggctggactgctgccacctcatgcccctcctggcatgatggtcgcatgaggctgagtgatttgcaggtctatggggaaacccgcctcagagatgtggaggagaagccaggcagagcgctgttcattccatttctttctttttttaatctaaaggagggaaagagctttattaactcaaacaaagggatgccatacaacttcccaacgatactgtgcagtgatggtattagcttccacctgttcttccattctgggggcagggtgtgaggactggctgctctgggagacgctctgagctgagagagaagaaatagctatgctaatagctgccccttactgagtgctcactctgtgtccggggctacaccgagtgcttgcagcgggttctcaggcgcacttagaacagcactgtgagaaaggcacttttgctgccccttgtgtacagatgaggacaaagagggacagagaggtttagaaccttgacctatatcacacagccagtgagcagacgaccggaatttgaatcctgcaatctctctgcagagcctgcgcatttaataccacacacagttctggcctgcagtgaatttggttgttcttcctgcctggggtggtcagtttccaagcctttccagatggacttctgcagcccaaagctgcgtgctccccgtgcaggcccttgtcagagcagagaaagatggctgaagttgttgtccatctagatttttatcttcaaaacattgctgaaatcaatctctcttctaccgtctccgatttcctttgtccttatgggtggtctacaactttactatcattttagtggatgcaagaggagtggagataaacacgtgttcagcctgctgtgaatctctgcagtggctatgttgtttcttaaacagatgtaatgaggcatctattccctgtgtgccatgtgccccttgagtaggggacatctgttttgtgttgtctgtgtctccagcattagaatggaacctggcacacaatagaggctcaattagtatttgttgaataaatgaacattaagaaacag

SEQ ID NO: 1144 - DNA, 2482 bp, Homo sapiens
cgacctcctccccgcacactttgaacgccgcgcctgaggccagctggcacatgcgcatgcgtgtctctggtgcctgctctccccaccaaagcaagaagcggcgggtacttgaagcggagtgagccggaagtcgctttgcctgcccatttccacgctgtaccggcggaaattcaagcactggaagagaggttccggggctgggctggcctgactgaaggcggcggaatggagacgcggaccgaggacgggggcctcacccgccgccccacgctggcctcttcttgggatgttgcaggcggggccctgacccacagcctcctcctcacccgggccggtctcggccccggtgacttcgactgggaggagctgctggcaccgcctgctccaggtcaggatctggtgattttgaagagaaaccacaacaacaaagatgaaaacccctgcttcctttacctgaggtgtggccctgatggaggtgaagaaatcgcttctattggcattttaagttcagcaagaaatatggaagtgtacttaggagaggagtactgtggaaccagtaggggcaagaatgtttgtactgtcctggatgacagtgaacatgaaaagatcattttgtataaaaaaaatctaaaattggagtcctccacacatgcttgtaaaataaagttgctctcctttggcgaaaggcagtgtgtgttcatcagtaaagttgtggtacacatgagatcagtttttgcaaattcttcaacaagctctcctgctctaggatcaaggatagaccttgacaaggtccaaaccataatggagtccatggggtcaaagttatctcctggagctcagcagttgatggatatggttaggtgtcagcagcggaattgtattcccattggagagcagcttcagtcggtgttgggcaattctggatacaagcatatgattggactacaatcctcatctaccttaggaaccttaaacaagtcgtcctccacaccttttccttttagaactggattgacatctgggaacgtgactgaaaacttacaaacttacattgataaaagtacacaactgcctggtggagagaattctaccaagcttgatgagtgtaaagttatgcctcaaaaccattcctttcttgaaaatgatcttaaaaatgcaatggcctctttcttaccaaagaaagtaagtgacaactcaaatatacccaactccgagttgctgccttttctccagaatttatgtagtcaagttaatcatctccatgtgggaaataagaccgagtgtcaggaaaacatcaccaagcatggtgaacgcattcttggtgttggaatggaagagcaatctatttgctcctacttggaaaagattctttctaaaaatatggaactgatggaaaagaaacttatggattacattgatcagcgaatacatgaactccaggagcacattgatgataagattgctttgttactggatttgctgcaaaatcctaactccccgcccactgggatacctctaagacattatgactctggagaaagactttcaaatggagaaagataagctctcaacataaacagtgtactgcagatatttattacatatttattacaaagccaaaacccaaaaatatttataaaaagcaagtatttaatgtcctttgagggatcattgtcttacacaaagtgacctcagttttcgtttttactacacttgttattttaaatccagtactgtacactgagttaatatgatacagtcaaattatttttgctcacgatatttttcagtcttacagaaatgtatgtatatttgtgttaagagtttaaaatgcttgaggatttctaatacagttcattagtttgtattgtatatgtgtttaagtataatttttatttatacaaagatcttatagtcttagaagtatgaaaaataatgcttaagagtatttgatttttttctttttctaattatcttggaaaattggatacttaagacttggagcctttacttcagattaccagtttacattttgtattgcttgtgtgagataatgaataagatgtgatatttggcatgtgtaaacttagttcactctggggttgttaatattatttgtttcattacagagtagctgtaggtaggaaagtaaacatcagaactagcctagtccttgttacgattagtactttggatttgatttttcctgtaaaacagatgcagtcatcttgtttgacctcagtaaccccagacagtttaagaaaacctctccttttgagctgatacaggttttttccccagaatccttttctggcatgtttattgtatgaaataatgaggctctccatggaaggatgaacacatatgagtcaagggattgcaattctctctgatagacttagttttcagaccttataactattgtatatgcattgaagggtgatatatttgcatataaaaataaatgcacctgctctgggaa

SEQ ID NO: 1145 - DNA, 1257 bp, Homo sapiens
ccaggatctgccaggactgggaagggaggcaggaggcttctctgggtataaagcagctgaaatgtggagtttcctcccaggagctgagagcgtgtccatgggcccagtgcctggcgtgtcctccctgggagcttgctggacgcatgaccaggattctgggagggcagaggacagaccacaggcacccaggataactcagtacacatgggttctcagcttcctgttcacagagaaacctcagacaagaagcacgtcgcccatttctcatcaaggccaaccccagaccacgagagcgctttctctgcgtcagccccagcaccccagcgcccctgcctccgggcgcccgcggcctccgcactccagtggcccagacctggctgaggcagctcccgtggtagatcaagcctcacaggcggctggaagagccagttctgggctgggcctgtgggaacaggcgtctgttagtcagggtttcaggaatgcggccttcgaagcctgaagcggggaatggcggctctgggccctcaaggggcaggcggtgagcctgggaggccaggccgggctgacccaaggggagaggaccctctccgcccactgccgctggccctgggcaggtctagagcctgggggtctccagaggcacaatcccttatctccgggagaaggcagagggcagaggcaggaaacaaatctcctgtcaaaattcctaattaaaatactaagtaagtgatggctccaggctgaaacaccggacactgagagaataagggaaaatcagccccgacagccagggctaacaagacggttaattacagcccgagaagaacgttaacagtattaattctaaccacaaaggaggaaaagagaagaccgcccttgccccagtccggcctggcccctcccacccttgccccagtccggcctggcccctcccacccttgccccagtccggcctggcccctcccacccttgcccagcccctgcttggcccctcccactcgtcccaacccttcgtgtcaccgccaacccttgccccagtcctgcccggcccctcccacccttgccccagtcctgcccggcccctcccacccttgccccagtccggcctggcccctcccacccttgccccagtccggcctggcccctcccacccttgccccagcccctgcctggtcctgcccacctcaccccagcacttcctatgggactcacgcctttgtctcgggcttttggttttcaaaataaattataagtttt

SEQ ID NO: 1146 - DNA, 1846 bp, Homo sapiens
ccaggatctgccaggactgggaagggaggcaggaggcttctctgggtataaagcagctgaaatgtggagtttcctcccaggagctgagagcgtgtccatgggcccagtgcctggcgtgtcctccctgggagcttgctggacgcatgaccaggattctgggagggcagaggacagaccacaggcacccaggataactcagtacacatgggttctcagcttcctgttcacagagaaacctcagacaagaagcacgtcgcccatttctcatcaaggccaaccccagaccacgagagcgctttctctgcgtcagccccagcaccccagcgcccctgcctccgggcgcccgcggcctccgcactccagtggcccagacctggctgaggcagctcccgtggtagatcaagcctcacaggcggctggaagagccagttctgggctgggcctgtgggaacaggcgtctgttagtcagggtttcaggaatgcggccttcgaagcctgaagcggggaatggcggctctgggccctcaaggggcaggcggtgagcctgggaggccaggccgggctgacccaaggggagaggaccctctccgcccactgccgctggccctgggcaggtctagagcctgggggtctccagaggcacaatcccttatctccgggagaaggcagagggcagaggcaggaaacaaatctcctgtcaaaattcctaattaaaatactaagtaagtgatggctccaggctgaaacaccggacactgagagaataagggaaaatcagccccgacagccagggctaacaagacggttaattacagcccgagaagaacgttaacagtattaattctaaccacaaaggaggaaaagagaagaccgcctaagaaggagaaggagggtccctttcccagatgaggctgccctaaccactgggacctcggcccctcccaggcctgagggagcccagctctgcctggccccacccatctcacaccagccctgcctgacccgcccacctcaccccaaccctggctggccccgcccacccttgcctcagccctgcccggcccctcccacccttgcccagcccctgcttggcccctcccactcgtcccaacccttcgtgtcaccgccaacccttgccccagtccggcccggcccctcccacccttgccccagccctgcctggcccctcccacccttgccccagtccggcccggcccctcccacccttgccccagtcctgcccggcccctcccacccttgccccagtcctgcccggcccctcccacccttgccccagccctgcccggcccctcccacccttgccccagtcctgcccggcccctcccacccttgccccagtcctgcccggcccctcccacccttgccccagtcctgcccggcccctcccacccttgccccagtcctgcccggcccctcccacccttgccccagtccggcctggcccctcccacccttgccccagtccggcctggcccctcccacccttgccccagtccggcctggcccctcccacccttgcccagcccctgcttggcccctcccactcgtcccaacccttcgtgtcaccgccaacccttgccccagtcctgcccggcccctcccacccttgccccagtcctgcccggcccctcccacccttgccccagtccggcctggcccctcccacccttgccccagtccggcctggcccctcccacccttgccccagcccctgcctggtcctgcccacctcaccccagcacttcctatgggactcacgcctttgtctcgggcttttggttttcaaaataaattataagttttaataaaataaagtactagaaaa

SEQ ID NO: 1147 - DNA, 1469 bp, Homo sapiens
agacgctggtagctcctggccagctcaaggtgtttccttttgcctggtaaccaggaggagtggctgaggcagggcatggagcggagcaacgcagctacaaagtgcggagaggagccccgctctggatcccgccggctccccaaggctgaaggagacaagtctggatccgcaggagcccccagtaagaacagcagccgcctggggggccgaccatgtatgtgtacagctggccgccgcccaaacagggcgtctggccgccgccgccgcagctgctcacctgcacctacctggccgcccctctgctgctacccccagtccaggcccacagcttccgcagccggcccgggagcctgcatgcgggcgagtgggcggccccacgggaataccaccgcttctacggccccgccgcgccacccgaggccgcgccgccctggtgggcctgccctccggcctacgccacgaccctgcgccggccctgcgccgccgccggcatctcgggactgtcgctgcaggcgcccgcggcggtggccgagagctgggcgccgtggccggagggcgggagcctgcaaaccgagctgcgctggggccgcgtggagcgcgcgcggggcccccctctgcagctaccggacttcgtgcgccgggagctgcggcgcgcgtacggcacctacccccgcgccgacgtgcgcgtcacccagcgccgcggccagttcctgctgcaggcgacgccgcgcgtgctcgagcccgaccaccgcgtggagtggcgcgtgcggcgccggcccgacagcggcgacagcagcccagcccgggaagccgcggagcgcggccgccccaggaagagcaagggcctgagctgaagccgccgcaaggcctaggggcgggcccgcgtgcacgcgcttggctctttcctgtgtgtgccgccgccgacaggcagaagtgagccctcacctgtgcgcgggaggcggacgcgctgctcacctgtctttttggcttctcccatgactgccggccagtttcctgcacttgtttctctcgctttattgctggacggtgggagaagggcaagtgcaagacggaatcgagggcacctctgggtgttctgtacctcttttcttcttgcaccttgggaagtggaggacgtgggatggaagaagggcctggacctccctccttcctcctccccaccttctcctaaggagcttgccctgcagtaagccccaactttcccttcctcttttccctctatcagagtcgtcgcccacccccctttcccaccgctcccctacccccgccttcctgccaagccgagggcgacggtgatccccagcttagtaagaaaagtaaataggccgggcgcggtagctcacgcctggaatcccagcactgtgggaggccgaggcgggcggatcgcttgagcccaggagaccaggttggagaccagcctaggcaacatggcgaaaccctgtctctac

SEQ ID NO: 1148 - DNA, 1699 bp, Homo sapiens
ggcaaggcccgacctgaagcactggctccagccttagggaaggttttggccgtgggttttgttggcacgtaccattttgctgaaagacagagcaccttgaggacgttatccctaaaatgagagaggactgggattgaaaggctgactacagaaatggctgctgcccagacgccctcaaaagccaaggatcctcagagttggttataaaatatttaagggcgagaaaaggatcgcaggagccaggccctgagatgagcttggagtccctgtttcagcacatcatcttcaccgagcatcaggcggaggagagtcgccgtttgatgcgagaagtaaggtcggaaataaccagatgtcgtgaaaaaattaagaaagcaacggaggagctgaatgaagagaaaatcaagctggaatctaaggttcaacagttttttgaaaaatccttcttcttacagcttttgaaagctcatgaaaatgctttagaaaaacagtacagtgaaattacaaaccataggaatatgcttcttcaaacctttgaggctataaagaaacaaatgatagaggaggaagacaaatttattaaggaaattacagactttaataatgattatgaaataacaaagaaaagagagcttttgatgaaagaaaatgtcaagattgaaatatctgacttagaaaaccaagcaaacatgttgaaaagtgaaatgaagtcaatggaacatgatagtagccagttaaatgaacttcaaaaacaaaagagtgaattgatacaagaattatttactctccaaagaaaacttaaagtttttgaagatgaagagaatgaatccatttgtactaccaaatatctagaggcagaaaaaataaaaatcagtgaaaagcctcaaaatgatacagaatgcttaagacttaaaaaagaattagaactttataaggaagatgacatggaaagtgtttatgaagctctccaaacagaaatagaatttttggagttgacattggcacagaaagatcttcaggaaagcaaataacttacagagaattgatcagccatctgagatttgatcagaatatctgagaatcaaatctttgtgatagatatatgaatggtacccgttacaacggatccttgtgggaaatatggggtttaaaatattcaaattgttattatctagaaatgatgtgttagccctttaagataatttttgtcttgttactcaaactttaagagttcttctgtggtttgattttgtttctaaaagaaggaaaaggagaagaagtagataccgtgttcccaggcttcttatatgcccctgaacctcaagctgtcctattctttctaatctatataatatggtttggatctgtgtccatgcccaaatctcatgttgaattgtgatccccactgttggaggtgggtcctgataggaggtgattgggtcatgggggtgggtttctcatgaatagcttagcaccattcttcttggtactgtccttgagttctcctgagagctagttgtttactagtgtatagcacttctccactttgctcctgctgccaccgtatgagatgtctcactccccctttgccttcagtcatgattggaaacttcctgaggcctccctagaagcagaagtcactatgcttcctgtacagcctgcagaaccgtgggacaattaaacttgtgttctttgtaaatta

SEQ ID NO: 1149 - DNA, 540 bp, Homo sapiens
atgagcttggagtccctgtttcagcacatcatcttcaccgagcatcaggcggaggagagtcgccgtttgatgcgagaagtaaggtcggaaataaccagatgtcgtgaaaaaattaagaaagcaacggaggagctgaatgaagagaaaatcaagctggaatctaaggttcaacagttttttgaaaaatccttcttcttacagcttttgaaagctcatgaaaatgctttagaaaaacagtacagtgaaattacaaaccataggaatatgcttcttcaaacctttgaggctataaagaaacaaatgatagaggaggaagacaaatttattaaggaaattacagactttaataatgattatgaaataacaaagaaaagagagcttttgatgaaagaaaatgtcaagattgaaatatctgacttagaaaaccaagcaaacatgttgaaaagtgatagacttaaaaaagaattagaactttataaggaagatgacatggaaagtgtttatgaagctctccaaacagaaatagaatttttggagttg

SEQ ID NO: 1150 - DNA, 1908 bp, Homo sapiens
aaccaggagtcggttgggctgagaccctgagccccaactgtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcaccctggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgagctggagagacagggggtcctgcttgtggaattcgaggctcctcttgtcgcaggcccaaagctgccagcccagcagcagagagtggtcttagaagaggatgtcattcctctctcaccatctgtaggatactcactgagaccaggggataaggtgctggcactctgggagccaggccaacagcagtatggccctggcactgttcttttgggcttggagatgagagatccccagagagcatcaaaggaaaaagaaatcactgttcatttctggaatggcaaagctgctaaagtgcccctaggtggggtccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagcccacagcacagcttttgcccctggaaggtcctaaagaggagaaagtagcaatgcacgctcccctggctgtttcttcctcctcatcctcctcctgtgaacaagacggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccttgggaagccaggaacaagatattccaacatctgcaaagaagaaaaggatcacaaacagcagagagcacaaactgcagtagtggggactaccaaggagctggtctcgaaagcaacccacatgaagccaccgcggaccccgccaggggaagctgaacacagaaagcggagtcagagccttgcaatatgtcagtggaacaagaattcccgttagactaagagccctgaggatctaggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttca

SEQ ID NO: 1151 - DNA, 1685 bp, Homo sapiens
accaggagtcggttgggctgagaccctgagccccaactgtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcaccctggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgagctggagagacagggggtcctgcttgtggaattcgaggctcctcttgtcgcaggcccaaagctgccagcccagcagcagagagtggtcttagaagaggatgtcattcctctctcaccatctgtaggatactcactgagaccaggggataaggtgctggcactctgggagccaggccaacagcagtatggccctggcactgttcttttgggcttggagatgagagatccccagagagcatcaaaggaaaaagaaatcactgttcatttctggaatggcaaagctgctaaagtgcccctaggtggggtccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagcccacagcacagcttttgcccctggaaggtcctaaagaggagaaagtagcaatgcacgctcccctggctgtttcttcctcctcatcctcctcctgtgaacaagacggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccttgggaagccaggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttca

SEQ ID NO: 1152 - DNA, 833 bp, Homo sapiens
attctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaagga

SEQ ID NO: 1153 - DNA, 469 bp, Homo sapiens
gggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttggctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagta

SEQ ID NO: 1154 - DNA, 818 bp, Homo sapiens
gtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagta

SEQ ID NO: 1155 - DNA, 2084 bp, Homo sapiens
cggaggggggcgccgagccgcagtccccgcccccacctcccgcctaccgcgaaaaacgcggaaatgcggtggctgcggcccgcgggcaggcgtcgggagcaagagtcggtcagtggtcacctgggacctccagcaggcgcacctgcagcccccgagactcccacgtgcctgccagacaccacgccccaccccgcaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccggcagctacagcagggactcagaagatctccagaaaacccactcacccaggcacggcgagccggtcctgtcgccccagccctgcacagacccggaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcat

SEQ ID NO: 1156 - DNA, 1818 bp, Homo sapiens
gttggcgggcagcggcacggccggcagggtcggggtccacaccagggcgcagaggacggccgaggcgtgtctgggccggcagccctggtagcaggcggggaagaggtcggagaggcagcgctccacgctgaaggccgccagcagccagagccccaccgcgaaccacaggaagccatccctcctcccccaggatccacatgggtcatgttcttagtcctgggagatgcatcaggaccaggctcagcagtggcggcgtcagcgaacactggacagtaagatgttcttgataagagagtttttccttccacggactgcgttccgcagctcctgggtggggtgcagagtgtgtcagctcaagccagaaattcggtcgtaaagatgctgtttctcttcacgtttctcaaatggacttggcttcggaaatcacttctgcaacacaaaccagcagcctgtgcagctctgggcgggggcatgccggctacccagctcccggcattgttgcacatggctttgaaacgcacggcacagctcgtgtggcccaggggcacctcctgccaccctgcctgctgcctccaccccagatgccggtcctcgctgctctccgggacctctcccggcgtggctccacctcctcctcgaggtcaccgtccaggcctgtttcaactagcgcctccaagccttgcttacctgcctcctgtttgggtgaaacttggagcatctctattaacttagttggtagctccggtcacctgcagtcaccaggggcccagagggacgcacagagggagaccggctgcctgggtccctcctggctgcctcaccatcaggggcgggatgaggagctcagcctcagccacagtgcgcaaggtgaagagttttgatccctcgtacatcctcgagccaggcagggcgcccggcttctatcccaggtagcagagtctcctatcccaggtctccgacggcgaccgcaaccctttgcccgtggaggacttcccctgtctaagggccattgggagtgggatggcctaatttctggggtcgctttctattgggcacttcaaacagtgctgggcaagggcagtcgtttgaggcagcttggagtgaagttcttagggaggaggtcctgcgcagctcggccagccccggtcaggcccaggcagccaccaaccctggtttctccatcacccctgacccctcccacagccccttctcgtgtttgcccaccgtctaggccatgcttccactttctcacctggctgggtatcccctatggggcacgggtgtcggccccgccgaggctgggctttggtctgtcttgttctctctgggaggggtctggtgcgggtggaatacgtggagggagcctccgtggggggagcaactgctcccggtgttgcaaggaggacagagccaatgcccgccccatcgtgtcatggccgacggtggcctcagaagatgtgtccacgtccccagtcgctggaagctgtgcacgagctcttcctggagaaaaggcccttggcagatacaaggattttgagatgagctcgtcctggagtatctgtgtgggccctaaatgcaatgacaagtgtccctatacaggaaaggagaggagggacactggagagcagggggaggccacgtgaggttggaggccagcaggggttacacagccacaggccaaggagggccagagccaccagaagctgaaagagatgaggaagcaccttcccctggagccctcagggagcgcggccctgctgccaccttgatctcagacttctgtcctctgtaaccaagggaataaagtcctgctgtgtg

SEQ ID NO: 1157 - DNA, 1790 bp, Homo sapiens
acgtggtagcgcgggcagaccagggggcacgcgctgttgcgcagcaggccgcaggcgttggcgggcagcggcacggccggcagggtcggggtccacaccagggcgcagaggacggccgaggcgtgtctgggccggcagccctggtagcaggcggggaagaggtcggagaggcagcgctccacgctgaaggccgccagcagccagagccccaccgcgaaccacaggaagaacactggacagtaagatgttcttgataagagagtttttccttccacggactgcgttccgcagctcctgggtggggtgcagagtgtgtcagctcaagccagaaattcggtcgtaaagatgctgtttctcttcacgtttctcaaatggacttggcttcggaaatcacttctgcaacacaaaccagcagcctgtgcagctctgggcgggggcatgccggctacccagctcccggcattgttgcacatggctttgaaacgcacggcacagctcgtgtggcccaggggcacctcctgccaccctgcctgctgcctccaccccagatgccggtcctcgctgctctccgggacctctcccggcgtggctccacctcctcctcgaggtcaccgtccaggcctgtttcaactagcgcctccaagccttgcttacctgcctcctgtttgggtgaaacttggagcatctctattaacttagttggtagctccggtcacctgcagtcaccaggggcccagagggacgcacagagggagaccggctgcctgggtccctcctggctgcctcaccatcaggggcgggatgaggagctcagcctcagccacagtgcgcaaggtgaagagttttgatccctcgtacatcctcgagccaggcagggcgcccggcttctatcccaggtagcagagtctcctatcccaggtctccgacggcgaccgcaaccctttgcccgtggaggacttcccctgtctaagggccattgggagtgggatggcctaatttctggggtcgctttctattgggcacttcaaacagtgctgggcaagggcagtcgtttgaggcagcttggagtgaagttcttagggaggaggtcctgcgcagctcggccagccccggtcaggcccaggcagccaccaaccctggtttctccatcacccctgacccctcccacagccccttctcgtgtttgcccaccgtctaggccatgcttccactttctcacctggctgggtatcccctatggggcacgggtgtcggccccgccgaggctgggctttggtctgtcttgttctctctgggaggggtctggtgcgggtggaatacgtggagggagcctccgtggggggagcaactgctcccggtgttgcaaggaggacagagccaatgcccgccccatcgtgtcatggccgacggtggcctcagaagatgtgtccacgtccccagtcgctggaagctgtgcacgagctcttcctggagaaaaggcccttggcagatacaaggattttgagatgagctcgtcctggagtatctgtgtgggccctaaatgcaatgacaagtgtccctatacaggaaaggagaggagggacactggagagcagggggaggccacgtgaggttggaggccagcaggggttacacagccacaggccaaggagggccagagccaccagaagctgaaagagatgaggaagcaccttcccctggagccctcagggagcgcggccctgctgccaccttgatctcagacttctgtcctctgtaaccaagggaataaagtcctgctgtgtgaagcc

SEQ ID NO: 1158 - DNA, 554 bp, Homo sapiens
gttgcgcagcaggccgcaggcgttggcgggcagcggcacggccggcagggtcggggtccacaccagggcgcagaggacggccgaggcgtgtctgggccggcagccctggtagcaggcggggaagaggtcggagaggcagcgctccacgctgaaggccgccagcagccagagccccaccgcgaaccacaggaagtcaggggttggggagtgcggctcgggccttggctcctgtgccttgccatggccgggcacacggtgatggtggcctgtcctccgagcccaaccaggggcagtgggagacctcggccgggccctggcttgtggtgaacactggacagtaagatgttcttgataagagagtttttccttccacggactgcgttccgcagctcctgggtggggtgcagagtgtgtcagctcaagccagaaattcggtcgtaaagatgctgtttctcttcacgtttctcaaatggacttggcttcggaaatcacttctgcaacacaaaccagcagcctgtgcagctctgggcgggggcatgccggctacccagctc

SEQ ID NO: 1159 - DNA, 693 bp, Homo sapiens
tcggtcgtaaagatgctgtttctcttcacgtttctcaaatggacttggcttcggaaatcacttctgcaacacaaaccagcagcctgtgcagctctgggcgggggcatgccggctacccagctcccggcattgttgcacatggctttgaaacgcacggcacagctcgtgtggcccaggggcacctcctgccaccctgcctgctgcctccaccccagatgccggtcctcgctgctctccgggacctctcccggcgtggctccacctcctcctcgaggtcaccgtccaggcctgtttcaactagcgcctccaagccttgcttacctgcctcctgtttgggtgaaacttggagcatctctattaacttagttggtagctccggtcacctgcagtcaccaggggcccagagggacgcacagagggagaccggctgcctgggtccctcctggctgcctcaccatcaggggcgggatgaggagctcagcctcagccacagtgcgcaaggtgaagagttttgatccctcgtacatcctcgagccaggcagggcgcccggcttctatcccaggtagcagagtctcctatcccaggtctccgacggcgaccgcaaccctttgcccgtggaggacttcccctgtctaagggccattgggagtgggatggcctaatttctggggtcgctttctattgggcacttc

SEQ ID NO: 1160 - DNA, 4004 bp, Homo sapiens
atatcccatgtacttatatgctctgtggaacatgttcttgtaaaattaacatatactctattacctccttattaatgggaaattctgagggactgccttcatccatcacaataagctgggcccctcagcgttccccgccccaagctgacaaggcaagttctgaggtccacagggagccaggagggaaggccgtctcttttcatccatgcaatgcctacactatgcagaaaagggaggacctcaagaccaagaagcgattatgttgcagcccttcttctgtgaacacgctcaaaaacacacgaatgttcccgctaaatcagtgactccatcaaccttgatccacaggccttggctgtggcagagggactgcaggaagccacgtggctgagaacccaccttcttattaccatgttgggcagtttctaggagtgcttcctggtttcagattttcttccctttcaaagcagggtgggggtggtgtaaagcccttgctcgggctaggagccagatacgtggcagcttaattttccccattatgcaggacaaataccaagaagaattcccaggtgtgtctgcagccgtgaaaatgtgacatgagtcacagtgtcttcggaggaaatgaaagaccacaggacggggacatggcatcatgaaaaaagatgctttgtgattttcaacatatggtgacacttttcctaatttagagggggaagctgggttttgagttttcttttatcctccctctttgttaaaagcaagagaaagaagatttaaagaacatctgtgtattcaaatgatagaaatagaattatacactttcaaaaacaagttctagtatttttgtctctttcaaagatttccgaagcctatagatttctctcgtgtttgtgagagcatttcctctgagaccttagacatagtgttgaagttgaaatggtttttgtctttttcccctttctgttaacccagcccccacttcattctgttaatctcctttaattggacttaagataagactgagtatgttcaatatttttattgaattgagttttatgtttccagtctggatttatagactgttaaatagaatgttttacgtttctctctctcgcaaagaaaataacaaatacgtgtgggacagagccatcagtcaattatatcagtggattgttggcaactcacagggggaaaaaaaagagcattttcactctactcttaggggaaagcaattatatttaagagcagtagaaagccaaaactagcctggaacttcaaaacgcctttcttgactgaccaagaaaaggtacagtgactacaatgacaaaccagcccccagctcttttagaaatctaccctgcctcatgctaaagagaaagtaagtgatgtttcagcctcggcgaccaggcaggaatagaaaaatacattgacagtagttggatagaccttaaaattaagtaaaaatttcttaatatacaagatctcagttttcccacaaacctcctttctgtccagaaatttccatgccatttactgcctgatcatgtcaggaatgacgttcttccttgttcttgattttccttcctggaatgttttaatcctgcctctccagaacacttttccctacttcttctaggccctactcacagcaatgtagctgacacatagcattagcgtgcaaaacctcaaatcctttctgacttggaacttcacccaggaaagacctctagcaaaagtgctggccattgtgtcacaggacaaacccctttcaaagaacaaagccatcatcatctcaaaagccacagtcaccacctggaccttccgtcctgaggaaaggaatctccaccgaatctagggggaagacccccccaccagtctgtgcaaaagatgaagaattgagtatgcacctacctgtgcccttccatttccacctcttcccaccttccccgtttctttttccgttcatttttttttccactttaaaaacatccaactttgccttggggatgagcagaatgaaatgtcacttacctataaaaagagacagaagagaaagccatgcatcacattacacacaagttctttgaaatcaaggccagcttccgactttgaaactgtaacaatgagtgaatattattttttcatcctacctttctatatttaatgaaactcaggagttcgcaagtagcctatccccagggcccagtctcccttcgtgattttccttttgtttctttgcctcctccgtccctcttcaccaccctagccccacaccctctgtccccgcttcatggatgaaaggtcaggaaggaataaggggggaggggtgcacagacccagagatcaaggccagccctcagatgtgggcagcaaggtttcgaggcatgaggagccgcttttcacctcttttctcacaggccacagagatgggacccagggtcagtgccggctggtgcctctcgggaggagggaggaaggtcagctccctgcagggtgattttccacctggtggcttctgggctctttcaaatgactctgctctgagtcttcctcctctctccctccctcaccctcaccccctccgccctcctggtttgggtgtgaatgaattcacccaaggtctccatccccctcttcatcctgcagcatctgtctttcagacctgcttctacagaaaacctcattattgcagcaccctgaggccaacaaccacctgaatgggtcattgtgttcagtcccctgcctcaatacatgatgcaaactggcccacccgagtcctacgggacactttgagaaccctgagatactgagtccccgccttgcccggctcctggccgcagaggctccctgtcttcatgcaacaagctccttgtggccgactgattcggttctgtcggctgtaaggaagccaggctctgagcattctacttgcaagaacagcccctcacccaccacgctatgtagcggatccttcacgtgctcacatattggaaaattggcttcagggtcctgccagtgtcttcttcttcttatgcctgaataactcatttccttttagactcttcttaaaggtttcagttttccatctttcctcctccaagctcctctgagaccctccgtggaggacagctcagagctaagccctggagagaaaagcagccacgtgtcccccgattctgttgctgcatcccccaaagagatttccaaccaagatgctctgccagaaatggaattacggtcaaatattgcatcccgatcacattggtatgttaaagacttggagagggttcgaggtaaagatctatgctgaaacttttcctaacggtatttgactcagaaatgtttcttgctatatataaactaaaacaccgtacttcagaaggatgactactttttctctcattatgaatgtaaaactaaatacaattgagttggtattatcacaagcagtggccagaggaccttgaagtcgatggcccggccaccatgcccagctaattttttgtatttttattagagacagggttttgccatgctgtccaggctgttctctaactcctgacctctggtgatccgcccacctcggcctcccaaagtgctggaattacaggcgtgagccaccgcgtccggccgcttacaccttttaaagcttctgattctgctgtctctgctctgtggctttgcatctgggcaagtttctccgcagaccaggaacctctaagtcgggggaggaaagagaggtcgctgaatcagagcaaggcatgccgtcctcgtctgcatcctctattactcttgaataagagagaatgcgaggacaaacgggcatcagcatagtgacgtgtccatgtaggttcacgaatgtaagagctgcaccacgtgggtgtggaatgttaacagttggggaggctggggcagtgggaaaaggggtctatgggaatgctctgtattttccccttattttactggaacctaaaactgctccaaaaataaagtttatgaatgaaaac

SEQ ID NO: 1161 - DNA, 654 bp, Homo sapiens
atggctctagtgcaggcgctggtgcccagagaaagagagccaaagctgtccattttgcagatggacagaggggacccacaacacagctcacactggtgcccagagagagaaaaagttaagctgctgaccctgaagccaagggaaacatccaaaaatatccttataaacttctacagagcctttaacttagataaggatgtgttcatacaccaggccaaccacccactaacagtgccgtctagtgtggtgatgggtgataacggccacaccttggcagaagatgacaaaagaccttgctttagggtactaccttgctatctggaacgtgtttccagtggaatctctatttcctggatctcagcccctctacctgtgggagcaatgaaacaccagcttctatgtgacttaatggatcttatcacgctttctttctggttagcaggtcagtgtatgagccttaaagctaccaacatgcaacactgcaagtgttcaatagccacaagtgactgggccattgaattggaccgcactgattacaaaacacttccatcagaatattccatcctagcactgctccaggtctttgcagggaaaaactgtatggatcgtgttctacttcatgtggatgtgaactacttgaagtccctgccctga

SEQ ID NO: 1162 - DNA, 1142 bp, Homo sapiens
ggggttcctgcagcagccactgccctgcccaatccctcccataccccaccatgttggtgggtacccccaacctgctgacactggatgaagctgatgccacctggaccctcatcaaggataaggtcatcgaggagcactttgggcccaatgcagtagcagtacctttcctgtcagatgcagcctgctatgacctactgggtgtgctggtaaaacagtcccgcccagcccatacccgcctggctttgccaggtcggcagggccggagggcactgaaaccagtggggccactaccaagcctcctggagcaggcaggatctgagggtgccttcgcccactgcactcgggaatactcaccaaatggccgagcagagagagcctatgaagagacgcgaatgttggatggacagccctgcaagatccgcctacatatgggtgacctgcgcaagaaggttgccttcctgttgctgccaccagggcaggtgagcctacagcagactcttccctggctccgaagcacccacagcatctatgtcatctaccaggtcttctcttgttcctggctgcagctggggctgacgtctacagcccgtgagccccagctcctccggctacttcggtcattacctgttgccttctcctgcctcaagttttcactgcagtctaagggcgtgctgggaccacagaagcctctcactaaagacccattgccccatggggccaactgggtcagacccaacctcagcatcatgccgcctctggcccccacatcagcacctgctgatacaactgaagctgctgatgtgcccccacctgtcccagccccacctacgccacctccccaggaagggccagaggacaaacccaccagattctcctacaagggccgaaaccccttctggagggggccccagatactgtcagagaactggctcttcagcccccgcagccctccaccaggagcccagggtgggggccccagggaccccgacgggcactccatgtccctgcccctgctgcagggtctatcctcagagttcgacagtgacgactgaagctgaagcaaaagattccgggggcaaagcccccaagatctggcataggggtactggtctctaataaacatcagctgctgctcccccaaa

SEQ ID NO: 1163 - DNA, 1322 bp, Homo sapiens
cagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctgaga

SEQ ID NO: 1164 - DNA, 2915 bp, Homo sapiens
attttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcaggtttagctgagggggttgaggtgtccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagtagaggcccgagctgtgctctgtggtttcctgcagtcacccgcgcgttttcaacacagcgcatggagggcatctacacacatacacatccctctccatcccctcaactctggaacaaacactcaaagtcaagtatactggttggagaaatgggtaatagttacttatctttaacatttattttacaaacaacctattccttttctcgtcatggtacacacttggtattgtttgggtttttttttggttttgttgttgttgttagtgtgtgggcgtggttttgtttgtttttggagacaaggtctcgctctgtcgcccagggctggagtgcagtggcgcgatcatggctcactgaagcctcgacttccagggcccaagcgatcctcctgcctcaacctcccggatagctgggattacaggcgtgcaccaccacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctcccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggttagtacttcctcagcctgtgtctggcagctggcttaccctccagtttggcccaacctccctgctgtccctattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctg

SEQ ID NO: 1165 - DNA, 899 bp, Homo sapiens
cccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctcccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagct

SEQ ID NO: 1166 - DNA, 1508 bp, Homo sapiens
tccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagtagaggcccgagctgtgctctgtggtttcctgcagtcacccgcgcgttttcaacacagcgcatggagggcatctacacacatacacatccctctccatcccctcaactctggaacaaacactcaaagtcaagtatactggttggagaaatggcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaa

SEQ ID NO: 1167 - DNA, 1645 bp, Homo sapiens
cggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaa

SEQ ID NO: 1168 - DNA, 1651 bp, Homo sapiens
ggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaa

SEQ ID NO: 1169 - DNA, 1916 bp, Homo sapiens
ccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaa

SEQ ID NO: 1170 - DNA, 1623 bp, Homo sapiens
cagctcccgtcccccttccgccgcgtgggtgccatggcaacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccagatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgt

SEQ ID NO: 1171 - DNA, 1069 bp, Homo sapiens
agctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaataatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctgctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccgga

SEQ ID NO: 1172 - DNA, 1166 bp, Homo sapiens
ctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaacagtgtatgccagggaacacacattctctttcgagaattcagcttcgtccaagccaccccccacaatagggtatcatttttacgggccttctggagatgcttccgaactgtgggcaaaaatggcgatttgctgaccatgaaagaatatcactgtttgctgcaattactgtgtcctgatttcccgctggagctcactcagaaagcagccaggattgtgctcatggacgatgccatggactgcttgatgtctttttcagatttcctctttgccttccagatccagttttactactcagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacagctgcccacccccagcacttgtcaaagaggccctcagcaatgttcagagactgaccttctatggattcctcatggctctctcaaagcaccgtggaatcaaccaagccctcggagctttgcctgacaagggggatctgatgcacgacccagcaatggatgaagagctggaacggctggtggtgaggtcgaagctgcaccggacctcacggcagcacagagccaaggagccaggggcctttggctttcagagaagagagaagcaggaggccctggagagagtgtcctcagcttcggtaccgacgccctaccattaccggtgggagcccagagagtgaggccaggggccggcactgggcagggaggcaggatccagaggacactgcttcactcagaccaacagggagccaggccctgcaggggctttattttgacaccactttgtttcaatacaaacagtccagaaagaaa

SEQ ID NO: 1173 - DNA, 886 bp, Homo sapiens
gggcgggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttcca

SEQ ID NO: 1174 - DNA, 848 bp, Homo sapiens
gagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctatctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttc

SEQ ID NO: 1175 - DNA, 734 bp, Homo sapiens
gggcgggagcggggaaaacaaaaggagacgaaggacgcatgcgtttgatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacc

SEQ ID NO: 1176 - DNA, 867 bp, Homo sapiens
gggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgatttt

SEQ ID NO: 1177 - DNA, 849 bp, Homo sapiens
acttcttggacatgagggtgtttaccgtcgtgcctaattacgcgggttgggaatctgagatacagggaagggcagcggctggccctgggtcggtcagataaattaagacaaaagcaggaccaggcatcgattattttctcctgctcatccctttcacggaggaattctaagccccgacacactgtatgacctaaagccagtctctgcctgtcgctgggcctcagttcgcctgtcctaagtttaattcagattatctggcactcctggtcggctccctcagccgctcaaagctgattgtacccttataatatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgccca

SEQ ID NO: 1178 - DNA, 563 bp, Homo sapiens
tttcggagccgagatcgctggtctgtcagtacttcttggacatgagggtgtttaccgtcgtgcctaattacgcgggttgggaatctgagatacagggaagggcagcggctggccctgggtcggtcagataaattaagacaaaagcaggaccaggcatcgattattttctcctgctcatccctttcacggaggaattctaagccccgacacactgtatgacctaaagccagtctctgcctgtcgctgggcctcagttcgcctgtcctaagtttaattcagattatctggcactcctggtcggctccctcagccgctcaaagctgattgtacccttataatatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgc

SEQ ID NO: 1179 - DNA, 812 bp, Homo sapiens
gcgacggtgggttgggctttcggagccgagatcgctggtctgtcagtacttcttggacatgaggatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttc

SEQ ID NO: 1180 - DNA, 468 bp, Homo sapiens
acttcctgtcacccagcatttctttcagttaattggtcctacccaggccccgcttttttcgcgtttagcaaccctataaggccaaatttctgtctgagacccgccctgctttctttctgttggtcaactgcatggtcattatcgtaatgagcaaagaaagggcggtggctttgcgacgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgag

SEQ ID NO: 1181 - DNA, 704 bp, Homo sapiens
gcttccgggtcgccgccggcagcagcctcccggcgcgtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgatttt

SEQ ID NO: 1182 - DNA, 1141 bp, Homo sapiens
tccgggagctgccgcggaaagctcaaccaggaacccggaaatgcacaagcctcttgatgcataaaaacagctgggctcccttggagacagagcgccatgggaaaccgggtctgctgcggaggaagctggagctgcccatcaactttccagaagaaaaagaaaacaggaagccaaacaagacggacactgaagccgcagccacaacagctgcagcagaatctcccaaagggccatgaaacaacaggacatacgtatgaacgggtgttacagcagcaagggtctcaagagaggagtccaggcctcatgtcggaagacagcaacttacattatgctgacattcaagtgtgcagccgtccccatgcccgggaagtgaaacacgtgcatttagaaaacgctacagagtatgcgacccttcgcttcccccaggccacacctcgctatgacagcaagaacgggaccctggtgtgagcgcttgggaggaaggcccagtccatcgttaaccactacacctgtgggggagaacctactgctttggggaattgggtggcaacccagggatgttgtccacgttttaagcttaaagaactccaaagcccctggaattgtgggcgtcccattttctcccctggcctcttacttgccactgttaggttggagttaatagttggtttagctatgggtggatagctaaacttagctatccacatgaggttaggtggagtgtgcagggaggtaggtcttcgaccccaccattgttgctcctgctcttgcaaagtgcagaaagagcaggtaaaaagttagcccataagcacgtgggctgatcttgttggactttaattaatggtatcctttttcacacaccttaaactccaaagctgaaggggaggtgctccggaaaagcattctgagcttttacattcagacactagggctggcttgggccatttcctcagtggctgagtcaggttccagaccttaacagacaaatgggggaagggggctgaggcgtggaggaaacgctttcaggacctcaagtcagtgataaccgacagcacagtgaggcctggaaacttccctcggagggactgttggctctcgcaggtgcggggccgctaggatcaataaacggcctgagaaacat

SEQ ID NO: 1183 - DNA, 551 bp, Homo sapiens
cagagctgagtggtgggccctgaacatccacttaaaggacaataaccaggcatccgaggaaaacactaaaaatggggtgagagaactgaacacaagaatgatgggtttcacagattctcgtagagcccatattttctactgcttgaagctcaagttcatggcttcatcaaaagacgcttcaaatcctgaagttgagatagctctcacctggagcccgtgtgttgttctaccctttggctgggaacacagtcacctgggaatcattccagcaggtggcttcaaaagtccaacctgctaggttgaaatctgacactgacacagactccgggagctgccgcggaaagctcaaccaggaacccggaaatgcacaagcctcttgatgcataaaaacagctgggctcccttggagacagagcgccatgggaaaccgggtctgctgcggaggaagctggagctgcccatcaactttccagaagaaaaagaaaacaggaagccaaacaagacggacactgaagccgcagccacaacagctgcagcagaatctcccaaag

SEQ ID NO: 1184 - DNA, 1205 bp, Homo sapiens
gtcccaggagactacagcaaacgagtgtatcaaggagtgagagtgaagcatacagtcaaagatctcctggcagaaaaacgatccgggcagacaagtaactcaagacttaatggcagcgtcagttcctctcagtctccatttgtgcagatgccaggttcgccggtcacgtcaggttactacggtgtcagaagatctttcttatctgactcagacttccacaacagtaaacagttttcaaatgacgtctacacctccagcgtggggaagccgtttccctgtgagtcctccgcagggcagagccatgcggctctcctggagccctacttcccccaggagccctacggagactaccggcctccggcgctgacgcccaacgcgggctctctgttcagcgcctcgcccctaccgccgctcctgccaccgcccttccccggagacccagctcacttcctatttagggactcatgggagcagacgttgcctgacggtctcagccagcctgaccctgtgtctgccgatgccctgctgaccttgccacccagcacgagttgcctctcccagcttgagtccgggagcatcgcccagcacaggggctcaagctgggggtcatccctggctggggctcagtcatactcgctgcatgctctggaagatctgcaccacactccggggtaccctaccccgcctccttaccccttcacccctttcatgacggtgtcaaatgacctaccgcccaaggtggggccactctccccagatgaggaagcagacaccggttccctccatgacccttccccttgggtgaaagaagatgggagtattgcctgggggtcatatgaatgccgcagagcttattgaggggagggccaaatgacttctgggtttttctttaacttgaggtgtattccaaagattgttttaggtgtgtcagcccattcaggactggattttcagaataagcctcaatgctgctctttgttagtggacgagggcatttatttgtaatcctctccactgtaaccccactgaaataaaacagaatgttaattaaatgtgtcagagaccgtattctagtaagataaccttacaatgtggtctttttggaactgttgtaacccattacgttctgaatcttctgttatctttgaagtatcatttttggcactgatttttcttaaattacattaaaaagtttatgcagatca

SEQ ID NO: 1185 - DNA, 2738 bp, Homo sapiens
gtgtgaagattcccccttcactcaccagatcatctccatggcaacagcttgcagcctgctcttggagtgctttgttttggcagcttctctgctagtttgtgtatggagtgaatggaggaggtaaatccacagattaagaatatgctgtcaggagtcaggcagccaaggtcagaagccagctctgcttctcagtggctctgacagccaggccagtgatgatgaggtccatcttcctgccacaccgaaagctcatctgcagtcggagaggccatctagaccccagaggttgggaagaagatgagaaaatcttggtacctgatgccattcccactcttcctccttatgtattcatcaggacggaccaggcttgtgttaaggtgtacccgggatttgttttaatcaggaatggcaagactcacaggcacagaggtgattgtcatgaggaagaagtctgtgctcacagaaccctagaaacaggaggcatggcatgccacgtagggccacatggggaaggaccatctctctggggcttttggggaagttggaaacaggtgctctttttccttcccgttgatcattaaacattgagtccctcgtctctagggaggggacttcttatttacccctgggttgggaaataaatcatgacagcagcaatcagacaacagcagagaagtgtgtgatctgaacatctgtgggatgccgtgatccctggaggagcccttcacactgatcccatgaatggccctcaacacatgcacgagcaaggagcaagcgttccgacaagtgctctcgcagtactccaaggaagaggctgaaatttgactcagcaaagcccagagggaaaagggaaagtggtttatgagtgtcctcaggagctatcacatcctagacactaggcactttcatctaaatgactctgatgaccccagtgttgtcagtgctcctcagtcagtggatcagacttgcccttggcatgaggaggatagtcagtcactcctggtccccttcagagggaccttttgagaaaaaaatatagccaattacttatgtaaccccaggcactctgtcctgaatcctgggcattccaccaccgtggagaaataggttagtcccagacacatgacaccagcctatgaggcagctccgggactcagctgctcgaacgagcgtcgcaatttcaagttgggaattaacggcaacacctgacaacacaacacaatgcagtagccatcaagcaggaagcccgagcactccactctcagctgtaccttgccaagcagtggctgctgtctgtcgggagcaggtagcaagtcaagatcagtctaaggacattccatgtccatctggcatcaaaccaccctgctacctatgccagttgttctcaggatttgttttaatcaggaatggtaagacataaggcacacagacgtggaaatgattatcatgaaggaagaagtttgtgctcatagagctctagaagcaggaggtgtggcacacggggccacatggttcggaaggataagtgttggtcaggaggcagggagaggggagagcatggccccaagcctttattggggttttcataggaaggaatggttaagacaaggtacatatgctggctaagtttagggttggatagtttgaataatttggatgggttcagggccatagggatggtcccgagttgtctgaccctagggtgacttagggcagagagaatattggcttggtgtgtgagagtttggttttaaaaagaagaagatggttgggagtgtgggctccagattagctggtttgtacatcaaaggcacgctcccaggagaattgtttgccaccccgcccccgacccgtgtgtctctctctctctctctctctctctctaggaatttgctagccctgaatggggtgacctctttggatcaaggacccaaatgttagcgcatgaagaatacagaaaataagaacatatactcaatacaaggttatgctgcagtaacaaacaatcccaaggttgtagtggctttttacacaactaaagtttctttgccaatgctgcacattcactgcaggttggaggaggagggcgggtagtctgctcactgtaatcactaagggcccaggatgatggaagcttcatctcaacacatgcctccacaatcaccaaggcagggaaagggactatggcaaattgcacctgtgatcttaaagctcctgcccagaagtaacagtcaaatcatatgggcacacctaaccatgaaagggcagagaagctgaatcctaccatgtgccaggatggaagagaagtgggatatttgtgattagttctgatgactactgacacctgtcattggaaccaaaagattcctcttttgcttaagcaaaaggaagaagaattgttcaaaagaattgtggccaggtgcagtggcttgcgcctgcaatcctagcactttgggaggccaaggcgggcagatcacttgaggccaagcgtttgagactggcctgggcaagatggtgaaactctgtcgctacataaaatacaaatatcagctgggcatgctggtgtatgcctgtagtcccagctattcaggaggctgaggtgggaggacttcttgagcttgactgaggtggcagtgagctgagatcgcaccactgctctccagcctaggtgacagagtgagactctgtctcaaaataaaaataaaaaagaattgtaataatacatgccccaacacccc

SEQ ID NO: 1186 - DNA, 3693 bp, Homo sapiens
aagtctcctcctttttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaa

SEQ ID NO: 1187 - DNA, 3669 bp, Homo sapiens
cttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaa

SEQ ID NO: 1188 - DNA, 2795 bp, Homo sapiens
cttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttg

SEQ ID NO: 1189 - DNA, 2322 bp, Homo sapiens
atatctagttccggaatgtcccccttctggtgccaggcttgcttttcagttgggcctgacccacttctcttccaggaaagcgcccgccttccttctgcacccgtcaacctctggagtgtcctgaaaaccctcccttgtgggagtctctgggctgcctgttggtgggacgatttctcaggagcacgacttccggcctgaaaaggaagtctcctcctttttctcccaaaccacttcttcccccctaccccccgccacgcgaggctgcggcgcacgattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactca

SEQ ID NO: 1190 - DNA, 809 bp, Homo sapiens
cccccgccacgcgaggctgcggcgcacgattgaagaatgtcccggattccactggggaaggtcctcctgaggaatgtcatccggcacacagatgctcacaataaggtgggaggtacaacctagttactcctcaacgcttactgaagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaa

SEQ ID NO: 1191 - DNA, 355 bp, Homo sapiens
cttcttcccccctaccccccgccacgcgaggctgcggcgcacgcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaat

SEQ ID NO: 1192 - DNA, 3739 bp, Homo sapiens
ggaagtctcctcctttttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataaggtgggaggtacaacctagttactcctcaacgcttactgaagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaa

SEQ ID NO: 1193 - DNA, 3693 bp, Homo sapiens; identical to SEQ ID NO: 1186

SEQ ID NO: 1194 - DNA, 2049 bp, Homo sapiens
acaaagctctcggccaacgctcaccgccatacacatccgcgggaacgcttcctccaccagccgaaggcggggcctctgagggcactcccgccacacagcgcgaattgagcctcggggcttcctgggaattgtagttttagtcacggacacatcttttttattcgggccagtatgcaatgaatcagaaaactacaactcccaaagtgccccggggcggcgaggggccgcaacggtgacgactgtggcagagaaggcccggaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctgtctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctatt

SEQ ID NO: 1195 - DNA, 1469 bp, Homo sapiens
agagaaggcccggaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctgtctatttagaaatatgtaaaactggatttttttttaagtaatatgtgaccaaagttaattttgtcccaaaggtctaaataaagagcagtttccc

SEQ ID NO: 1196 - DNA, 2495 bp, Homo sapiens
aatctgttcctcactccagcgccctcatgcccccacccttctcttcagctcggggcttcggcgcgcctcgtccccgcccttcgccccgggagaggagcgggcggcgtgggagggctcgcggagaaaggcccaggggagtggacgacctccgcccggcagccacatcctcagcagcagagacccggagccatccgcccgcgggcgagccaggcccgagggcagccccggagaccgcggtggccggatgcgcgggcgcgtcacttccgggcggtgcagcggcggccgcttggaagatggctgcgccctgtggctcggagctgcccgccaactcgccgctaaaaattccgaagatggaggtgctttccccggcttctcctggtggcctgagcgacggaaatccatcgctgtccgacccttccacgcctcggggtgcctccccgctcgggccgggcagtgcggcgggctcgggggcagcggcgtccgggggtctcgggctggggctggggggccgcagcgccgcctcgtcctcggtctccttctcccctggtggcggcggtggcggggctgcggcagccgccgccgccgcctgccggggcatgtcgtggacgccagccgagacgaacgcgctcatcgcagtgtggggcaacgagcggctggtggaggcgcggtaccagcagctggagggagccggcacggtgttcggcagcaaggcccccgggccagccatgtacgagcgcgtgtcccgggccctggccgagctgggctacgagcggaccccgtcccagtgccgggagcgcatcaaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaacctttttttaaaaaaaaaaaattaaagtaattcctggcc

SEQ ID NO: 1197 - DNA, 2349 bp, Homo sapiens
gcttggaagatggctgcgccctgtggctcggagctgcccgccaactcgccgctaaaaattccgaagatggaggtgctttccccggcttctcctggtggcctgagcgacggaaatccatcgctgtccgacccttccacgcctcggggtgcctccccgctcgggccgggcagtgcggcgggctcgggggcagcggcgtccgggggtctcgggctggggctggggggccgcagcgccgcctcgtcctcggtctccttctcccctggtggcggcggtggcggggctgcggcagccgccgccgccgcctgccggggcatgtcgtggacgccagccgagacgaacgcgctcatcgcagtgtggggcaacgagcggctggtggaggcgcggtaccagcagctggagggagccggcacggtgttcggcagcaaggcccccgggccagccatgtacgagcgcgtgtcccgggccctggccgagctgggctacgagcggaccccgtcccagtgccgggagcgcatcaagacccttcgcaggtgttacagtcgggtgaaagaacatggtgttgggaaaagaaagagcagttacacatttgaacagttggaacaggtgtttggtcagggaggatgggatgctcagccctgccagcctgtacttattaacagtagtggcttgtaccaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaacctttttttaaaaaaaaaaaa

SEQ ID NO: 1198 - DNA, 3086 bp, Homo sapiens
gtgaaaatagttaacatattggcttatggagagcaatctcacgtttaggataaatttagtctggcagtgcctacaaattaagtctgaggtgaactacttttgaacagttgagttagaaagtatttggtagccaccagggaaaagagatcttatttcaagaaaataattagtgaaactcagtaaagtagaagggagattagaaggaacaaagggaggcagagatgggatagagactggttgcaacttaactaaatttggaagctgggattaagcccttgatttatcttttgaaatgccatataagatagcataagatgtaccattaaattcaggaaactgggctaataatcagaaatatgtgttagaaataaagaccatggtaaaaatggaagggttgtacaagagaataaaattattcaggttttgtctgtggatttgcataatgatatttatttgctgtgtgccacatggcagaaaaggaagtgaaataacacccctctgtcccgtccttttccccagaaagaaatcactggcttcatttgttggtttgtttagctggcagcttgagttggtagaacagacgagtagattgtctagctttagacgtaggtattagtgtactgtttcttgatcattgatgtttgagacctggaatttgtagcattattgatttgacctctgttttaaattttagcggcttccacaaagactgagttagtaaggaatacaactatgtaagtaatatgttttactagctaatttgtctaggcaattatttttaccctgtattcattccttcttaatcaagagtaaggcaggtattctttgctttgggaaattcttctttctgtcctcccttccctcactttttccaaattctgggcacaacagcagctctctctcttctgtggcaggtgtgcatcctattggctggctggtatttcttgttttttttcccccttattctttttaaatgggggtgggggtataaaaatatgtgtatggggtacatgcaataatgttgtaatgtttcttgttgtttaatggataattaattgcaaaataattgttttaattataacatgtttgagtaaatgctaaattagtatttttttctaatataataatgaatttgaaatctagcattcctgtaacaatgtgtctatgtttgtctgtctgtgtctgtctaatagtaattaatatctgtggtccgtacctggaagaggaagtacagctttaaaggaataacaaaagactttgtgtcttagacccttcgcaggtgttacagtcgggtgaaagaacatggtgttgggaaaagaaagagcagttacacatttgaacagttggaacaggtgtttggtcagggaggatgggatgctcagccctgccagcctgtacttattaacagtagtggcttgtaccaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaaccttttttt

SEQ ID NO: 1199 - DNA, 2910 bp, Homo sapiens
gtttgcagcctccgtgccagggccgggggtgcggttcgggacgcgggatcctaggtcgggtcctgccccgcccatgtggcgccggcgtctgtgttgtctgcggtctccagggcagcgccggggcgggcgggggcccgggcggcggcggcggcggcgcgggaggatgcggggcccgtccgggtcgcggccgcggaggagcgccgggcaggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagtaacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttgttttatattg

SEQ ID NO: 1200 - DNA, 1947 bp, Homo sapiens
gctgggaagtccgggcggcgaggcagcctctcccggggcgttcgggctcctccggctctgccccgatgtcgttattacggccgtttgcagcctccgtgccagggccgggggtgcggttcgggacgcgggatcctaggtcgggtcctgccccgcccatgtggcgccggcgtctgtgttgtctgcggtctccagggcagcgccggggcgggcgggggcccgggcggcggcggcggcggcgcgggaggatgcggggcccgtccgggtcgcggccgcggaggagcgccgggcaggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacaggtcattttgagagtaaattctctcccacgtgatggattcaaaaccttttggagccagtaaacttagttccatttcacaggtgcacataaagaccttcctgcccacctcctatggacatgtccagggatacaggacaagagtggggttagaatggtagagtccaccactcttactggaaagagcttgagatttatcacctgctaatgtgaggtcattttcaaatacaaaggagaggttattatgttaaatgtggttgcccttagacctattccaaatcccaactggtatttttttttaacatattctaacctgttctaacctctaagcattttctaatggaacaaaatagatgaggtggatgaacatttgtggcttttcttcagagactcccttttttgtcttaaagaattacgtctggtggcacgttggctcatgcctgtaatcccagcactttgggaggtcgaggtgggaggatcacttgaggccacgagttcaagaccagcctggccaacatggtgaaacccatctataccaaaaatacaaaaattagccgggtgtggtgatgcacacctgtaatcccagctactcgggaggctgaggcacaagaatcgcttgaacacgggaggcagaggttgcagtgagccgagatggcgccactacactccagcctgggttatagagtgagactctgtctcaaaataaat

SEQ ID NO: 1201 - DNA, 2782 bp, Homo sapiens
caggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctgcacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagtaacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatagacaacatttgataggaaggagaccaaaaatggtccaggaatgaacgtggagaaaagaaacgccaaccaccttctctgcgttgagagtaatggcctattattatcatctatctgccgtccatgtttgctttctgcaggatttaaaatatgaggcccaattggattatggtgccatattttactttctaggaagaaaattttttaaattatttattttcaaatcagttagaattggagctgaataataactagagaataaagcttttgttttatattgatcttttgatttcttcatctctaccccattccttagcataatggaaaccttaaagttacccagaaataaatgtagct

SEQ ID NO: 1202 - DNA, 1033 bp, Homo sapiens
acgtcatttccgcctgcgacgttacctaggagtccagcggcgcccgggccagcagcgattggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggcagagcttctagatgctgctgctggcattcatgtgcgattcagattaggtggagttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgagtacattgccagctggaaggaaattgctacaagcaactcttcggctaacttcaaaggattcaggtttaatcaagcacagaaaaacatatataactatggaggagacatatcaaagatgcaaatgggaataccagatgatacttactatgaaaatgtttatcaagaaccaaatgtaactagattaacgcctgattctacttatggactataaagtactttatttctattctga

SEQ ID NO: 1203 - DNA, 973 bp, Homo sapiens
ggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggcagagcttctagatgctgctgctggcattcatgtgcgattcagattaggtggagttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgagtacattgccagctggaaggaaattgctacaagcaactcttcggctaacttcaaaggattcaggtttaatcaagcacagaaaaacatatataactatggaggagacatatcaaagatgcaaatgggaataccagatgatacttactatgaaaatgtttatcaagaaccaaatgtaactagattaacgcctgattctacttatggactataaagtactttatttctattctga

SEQ ID NO: 1204 - DNA, 531 bp, Homo sapiens
agttggggagcgcagatcccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctatgcctgtga

SEQ ID NO: 1205 - DNA, 579 bp, Homo sapiens
gtattcccggagggcagttggggagcgcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 1206 - DNA, 1619 bp, Homo sapiens
cggccgctgcggccgctgaggcccgcggctccgccctgtggctgcgcctgtctataaagttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggagcaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccagcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctaggggggccaaattggggagactgcccactcccccctccatgctggggttggatcctcctgtcttcctccttgtcctatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaata

SEQ ID NO: 1207 - DNA, 1559 bp, Homo sapiens
aaagttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccagcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctaggggggccaaattggggagactgcccactcccccctccatgctggggttggatcctcctgtcttcctccttgtcctatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaa

SEQ ID NO: 1208 - DNA, 520 bp, Homo sapiens
agccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatgggcttttttcaaagacccaaatgttattcccaatttgaagttactttcagattcttctggacaatggatcatattaggttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgaggtaatgttgctagatcacaatatgtaaatctctagttaatagaataaattatttgcttaaccttg

SEQ ID NO: 1209 - DNA, 2193 bp, Homo sapiens
cccaggcatccacccagccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaatacagattacctcttctgtctttaaagtttcagcttatgattctgctggtatgtgctatccttcagcaaagaatcatgaacagacattttcttactttattgtggatcctatcaggcgtcaccttcatgttttataccactgttatggtgtgggagacatgtcttaatgttctttcagattatgtacctctactattttgtatttatcatttttctatcttaatactaacttatagataaacatatactttgcaaattaattcaagaaaaatgtaaggagcctacttagagcagaagaaagcaaacaccaagatgcctttttaaaaatttgtgtggaatactaaccggggatcaaatttcatccataataaaatctataccaaaaaagttgtggaatttttacagaaagttacaaggaattagaaatctagttcatatttgttgcattgtgattcaagtgaatcctcaattttccatgtattttaatttataagctaattaattatggattgaaaatgtagcagaaaactaaacatgtctaccactgatcattaatatgaattgttagtttatttaacttgtttcatttaattacatttcttcattgcacaagcgtttacatctgtaaagctaggcaaagcataacaattcttttgcttcatttgttccacttataagcctcagtaaagaagtaacgttctggggcctggcacggtggctcacgcctgtaatctcagcactttgggaggccaaggcgggcggatcacgaggtcaagagatcgagaccatcctggccaacatggtgaaaccccgtctctaccaaaagtacaaaaattagctggctgtggtggtgtgtgcctgtagtcccagctactcaggaggctgaggcaagagaatcacttgaacccgggaagtgaggttgcagtgagccgaggctgtgccactgtactctagctctggcaacagagcaagactccgtctcagaaaaaaaaaaggttctgaaagtggttgtaaactcttgtatcacataataaattaaaactgcagctgtcccacggctaatacaagagctacatgtaaacagagaaagttgcctgatggcattagtaagtcgttcaaagagtgagaagcaggttatcttagtactgttccttatttcattcatagaatgaatgtataacctagattgtttttggtttattttgatggcaaaaatcattgacatatatcccatgggtcatgggaagcctgtaagaaatgttgaggtttgaggaggagcaagtttgaaagatgtgtttctgtgttgtgggataaagacgataatcttggacttgaacctggatttgaatctggaatgcagctggcaatttgggtatagagctcaggagaaagagtatgttttacttctaatacctaacacaatgacttggcatattaaatgtttattgaatgaataactactttctagatatcctcataatacccatagatttttttaaattacataaaaacataaaatcaagaactg

SEQ ID NO: 1210 - DNA, 520 bp, Homo sapiens
agccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgaggtaatgttgctagatcacaatatgtaaatctctagttaatagaataaattatttgcttaaccttga

SEQ ID NO: 1211 - DNA, 652 bp, Homo sapiens
gacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggagttactacctggaccctgaagctatctgagtctgcaacccctgatttaagatggtgttcaacatgcagccattcaaatatttttgaaattttagtaatatgaactgatttgtgatataattacatttatattatttaagataaaaattggatatgaaattgtatgtattatatgatcttacctatatgaatgaaatatgcattaaaaaactagaattgccaaaa

SEQ ID NO: 1212 - DNA, 2431 bp, Homo sapiens
ctctttcgctccctccttagctcgccggctcccagcctttgatgccacaagtaaacaaacctcgcatgtcgccttctgctgggtcctggaggtcttggaagcctgatgaactcgtctttttcagtttcctggaaccctctgctgtggtcctcgtgataagagtgacctttttggcctgctctccccagctcttttccagtcctcatgcagggtatcagcattgctgagtggcctgcccaggatgacacaactgccagaactcggcctgaggtctcctaacaacaaatcccccactggtccccacccactggagcacctacttgccaggcttctcaagcgaagaaggagatccactctgatgtcatctcccaggagccttctctgcagcatctcaggtcctggctctcacctcctcagcacccatcccatcctgtgtcactctgtatatcagcctccccagccagcctccaggccacaagccaagaggtatcaagggctcctccctgtcccactggccccacatccactgtgtctatctggtcaactttaccttccaaacattccctgcacagtgatagatggctgtggccctgtcatctctcacctgaaattaacaatgtatccttggggcctcccaccctcacatcttggctcctccagccccttctctgcaaacatggaacagtgggattattataaatctcagacccgttttgcccctttcctgcctgagagtttttgtggttccccactgccctcagaacaaagctcaagaccctttggcctggcattcaaggtcctttgtgctgccacctgtcaacctccccagttccagctcctttggctttgcccatacaagctggatctgcaccagaggatctgtcttcctcccaacttggccctagtcctcctaggagccctttggacgtcacctcccccaggaagctttctgcaaccaccctacaaccgtccctataaactttataaaaccaattagtgtggggaaaagcaagagagatcagattgttactgtgtctgtgtagaaagaagtagacataggagactccattttgttatgtactaagaaaaattcttctgccttgagattctgtgaccttacccccaaccccgtgctctctgaaacatgtgctgtgtcaactcagagttgaatggattaagggcggtgcaagatgtgctttgttaaacagatgcttgaaggcagcatgctcgttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctcttcccacaattgtcttgtgaccctgacacatccccctcttcgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacaaattagggaagaagtagggggaaaagatgaaaataaaccaagcctgcagcatactcagtattcatcatgaggtcagctgctctctgacctgcttcctcatggctggttggtgcctgttgtcccggagtgacaaagaccctagattatagctgcccttaactgctgtataaataacaacttgaacatgaaatgctaaattttccttttgaagtattccttcagatcctgcatgctgataaaactactgactcaactggtccccatgaggagctggctcaccaaagaatgcggtttccaatcccaattatttcatgccccttgcttaggcaatcaacaatcccaaatttccagccccttgccctccacaatctccttaaaaaattcagtccaaaactccttggggagatggatttgaaggtctcctcccatctccaaacttggtgccctgcaatcattaaactctttctctgctgc

SEQ ID NO: 1213 - DNA, 1126 bp, Homo sapiens
cctctgctgtggtcctcgtgataagagtgacctttttggcctgctctccccagctcttttccagtcctcatgaagcagggtatcagcattgctgagtggcctgcccaggatgacacaactgccagaactcggcctgaggtctcctaacaacaaatcccccactggtccccacccactggagcacctacttgccaggcttctcaagcgaagaaggagatccactctgatgtcatctcccaggagccttctctgcagcatctcaggtcctggctctcacctcctcagcacccatcccatcctgtgtcactctgtatatcagcctccccagccagcctccaggccacaagccaagaggtatcaagggctcctccctgtcccactggccccacatccactgtgtctatctggtcaactttaccttccaaacattccctgcacagtgatagatggctgtggccctgtcatctctcacctgaaattaacaatgtatccttggggcctcccaccctcacatcttggctcctccagccccttctctgcaaacatggaacagtgggattattataaatctcagacccgttttgcccctttcctgcctgagagtttttgtggttccccactgccctcagaacaaagctcaagaccctttggcctggcattcaaggtcctttgtgctgccacctgtcaacctccccagttccagctcctttggctttgcccatacaagctggatctgcaccagaggatctgtcttcctcccaacttggccctagtcctcctaggagccctttggacgtcacctcccccaggaagctttctgcaaccaccctacaaccgtccctataaactttataaaaccaattagtgtggggaaaagcaagagagatcagattgttactgtgtctgtgtagaaagaagtagacataggagactccattttgttatgtactaagaaaaattcttctgccttgagattctgtgaccttacccccaaccccgtgctctctgaaacatgtgctgtgtcaactcagagttgaatggattaagggcggtgcaagatgtgctttgttaaacagatgcttgaaggcagcatgctcgttaagagtcatcaccactccctaatctc

SEQ ID NO: 1214 - DNA, 863 bp, Homo sapiens
tctctctgggatgtgtagctttggaaatctgtctttgttgctctgggagaggggactcctggaatgtgtctgtgaataaagactagccgaagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctact

SEQ ID NO: 1215 - DNA, 633 bp, Homo sapiens
gtgtagctttggaaatctgtctttgttgctctgggagaggggactcctggaatgtgtctgtgaataaagactagccgaagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataa

SEQ ID NO: 1216 - DNA, 895 bp, Homo sapiens
agctttggaaatctgtctttgttgctctgggagaggggactcctggaatgtgtctgtgaataaagactagccgaagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagagttaagaaaacttattttaaactatttatggcctttaataattgagtaaggtatactcctgcaaacaaaatttggagcacgtttgtttctgtctgcctggttcctctagaagttggaaactgcctctttttgcctacattttagactaaccctgcttattcctgtgaatcaagtggtgatctcctgcagcttggaagaaacaaaaaggcatagcaatcaaaccccaaatggtgctgcagacagagccacacatggacacaccattcttctgagaacacttagattgacctcaagagg

SEQ ID NO: 1217 - DNA, 366 bp, Homo sapiens
tgtgaataaagactagccgaaggtgcgaagtgactagacgggagcaaaggaggaaaactagggaatgggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatttgctgctgcttccaggagaagtggagcaggatgtaagcaccagcattccttcctgtatcccttttgtggcccagcctcctacctgtgaagtgaagccaaagcccagtgttaaaagaatggacaaacagacgga

SEQ ID NO: 1218 - DNA, 631 bp, Homo sapiens
tcctggaatgtgtctgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacaggtgacccgataggaagcacaactgcttctgttggagtgcggttacctggagaccgcagtctgaagggactcccggcagagatgtcgttacggtgtcctgcctgtctggatgcttaggagcgcgactcaaaactacacccctgacgaccctggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaa

SEQ ID NO: 1219 - DNA, 694 bp, Homo sapiens
gtgtagctttggaaatctgtctttgttgctctgggagaggggactcctggaatgtgtctgtgaataaagactagccgaaggtgcgaagtgactagacgggagcaaaggaggaaaactagggaatgggagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatt

SEQ ID NO: 1220 - DNA, 534 bp, Homo sapiens
acggtgtcctgcctgtctggatgcttaggagcgcgactcaaaactacacccctgacgaccctggagaaagatactgtactgtgaaacattaaatcttgctgatccgtgctggccatgttttcttgattgctccagagtagcaagtaacctcatatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgagg

SEQ ID NO: 1221 - DNA, 801 bp, Homo sapiens
tagctttggaaatctgtctttgttgctctgggagaggggactcctggaatgtgtctgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacagatactgtggcctcatgaataggaatgtctgcccatatgtcaggattggaaataatggatgaagatcaattaatcaaagacgtcttggataaattccttaattgtcatgagcaaacatatgatgaagaatttctgaacacttttactcatctttcacaagatttgctgctgcttccaggagaagtggagcaggatgtaagcaccagcattccttcctgtatcccttttgtggcccagcctcctacctgtgaagtgaagccaaagcccagtgttaaaagaatggacaaacagacggaagagatacttggagatgaagttcaacttttttcacttgatgaagaatttgattatgacaatgtgatgctaacctccaagtttagtcctgcagagatagagaacatcaaagagctatgcaagcagcagaagagaaaggacaccagcccagacttagagaaatcctgtgactgattcacagaggcattttgtgtgtgtgtgcttattttaattttgttcttattctagcaacattagaataaaagataaacctactataatt

SEQ ID NO: 1222 - DNA, 2027 bp, Homo sapiens
ggaagggatgggctcgcgctgccgggcgtgggcgtggactcgggcgtgggcactggcggagttccaagcccgggctgaggagggggcggcggcggcggcggcggcggcgggcgggtacccttcgactgggcgttgccgctgttccctgcgcggcatggaggggacggccgtggccgtgttcgagattttgagatttttaataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtcc

SEQ ID NO: 1223 - DNA, 2323 bp, Homo sapiens
ggaagggatgggctcgcgctgccgggcgtgggcgtggactcgggcgtgggcactggcggagttccaagcccgggctgaggagggggcggcggcggcggcggcggcggcgggcgggtacccttcgactgggcgttgccgctgttccctgcgcggcatggaggggacggccgtggccgtgttcgagattttgagatttttaataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtcctcttccgcgtctgcttccgcgtcgggcccgggcggggcggggcggggcgtggagccgcgccgcggcctgacgtcacccacacctccctgggactgcgtcactggtgcgcgccgcgggtcagggcgcaatggcggcgctgggcggggatgggctgcgactgctgtcggtgtcgcggccggagcggccgc

SEQ ID NO: 1224 - DNA, 1786 bp, Homo sapiens
actggcggagttccaagcccgggctgaggagggggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcacc

SEQ ID NO: 1225 - DNA, 2024 bp, Homo sapiens
ggctggccggccgggcgggcgccgacaatgagcctccataaaagggagcggcggggggcaggggccccggattgagccctccccgcccgggctcccgacgcgccgaggtctcggggaggcccggacgcgccggtcgcaggcccggccggcgagcggcgggcgggcggcggggagggggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagccggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccacccctgcagaggcctgaagctgggcctgggcaccccattcactcccgttctcatttacatctgttttcctgttgtatatatcacctttgttgacaataaattatttttttttattaaga

SEQ ID NO: 1226 - DNA, 843 bp, Homo sapiens
tggggctgagagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggattctgtccgcgtggtcttgggaaacttggacaatcttcagccctttgctacagaacacttcattgtatttccctataaaagcaaatgggagagagtttcccacctgaaattcaaacatggggaaattatcttgatcccctacccatttgtttttactctatatgtggagatgaaatggttccatgaaaacctgtcacctgggaaaccaataagtgacagtcctcttgggttggtcccagttgagaagaaagcagtaggagctgtgatgaggaaacgaaaacacatggacgagcccagctcccccagcaggccagggctggacagaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctc

SEQ ID NO: 1227 - DNA, 835 bp, Homo sapiens
agagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggattctgtccgcgtggtcttgggaaacttggacaatcttcagccctttgctacagaacacttcattgtatttccctataaaagcaaatgggagagagtttcccacctgaaattcaaacatggggaaattatcttgatcccctacccatttgtttttactctatatgtggagatgaaatggttccatgaaaacctgtcacctgggaaaccaataagtgacagtcctcttgggttggtcccagttgagaagaaagcagtaggagctgtgatgaggaaacgaaaacacatggacgagcccagctcccccagcaggccagggctggacagaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctc

SEQ ID NO: 1228 - DNA, 2046 bp, Homo sapiens
ctggtgggtgcgcggcacgagccccgaagttgcttaggagctggcgagccagtccctcaaaacgacttcgttcgaggttggcgcccgcctttttcagagagcacttcttagtgggtattccgtccggggccacttttctgaggccgaaggacccctagtcagtgtgtgagacatagcctggccgagcctgggaaccacctggggctgagagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggtagggaaagaagcatacgacttctggaaaagttactctttaaggatgcatccacattcaggttttaattatttcctacaaactgagtcacaacctccacttgataacttggcttcctcctgctacatctcctttgcaaaggaactttatgtttttccatgggaatttaaagcctgtattctttctcagttttcctagttgaaatgtcagcacctttgaggctgagagctttttgttttcaccagtttccagccttgggcagctctcttttgttgcagctggcatagagaaagattccggaggactgcctccttccagggctctgggaaacctcaccatcccaaccactgcctggtacttgacgttcaggaaactcgactgtaaatacacagacaaggctgctgtgtcttcatttaaattggcaacatttgcaattgccttattccgacttcattttcattcctttctacccggttcctctagctttaggttttcctacagaagaagactgagcaggtgatcaactttacaaattggtggaagcaatggacaaggagttagagttctgggggttggccctggattccagtcctggcatagccaccacttagctgtgtgaccgttggcaaatcatatatcaacttggatcttaattgcctcatttggaaaatgagaggtctaaactagcttttcctcttctgacttcacaattcggattctgtccgcgtggtcttgggaaacttggacaatcttcagccctttgctacagaacacttcattgtatttccctataaaagcaaatgggagagagtttcccacctgaaattcaaacatggggaaattatcttgatcccctacccatttgtttttactctatatgtggagatgaaatggttccatgaaaacctgtcacctgggaaaccaataagtgacagtcctcttgggttggtcccagttgagaagaaagcagtaggagctgtgatgaggaaacgaaaacacatggacgagcccagctcccccagcaggccagggctggacagggccaagatagggacttccagccaaggccccagcaaaaagaagccccctgtggaaaccaggagaaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctccaactctatccttttcttatgacacttcagtcgtggggaatgaggtccccatgctgagtcctctgtggttttatcgtgtcctttgcccctttataatagattttttcccccaatttaaaacattaagaatggaactttctaaaatgttcatgtcctgagggccggtttaggccttttgtcttcggcacttaggatcctaatgacaataaattatttatgaagagtt

SEQ ID NO: 1229 - DNA, 1187 bp, Homo sapiens
agatgggtggaggcactgggccacctcagagggccagtgtcttgctgaggggccggagcagtcctgtgcctgcagcctccggagccatgggaacagggctgcgaagtcagtccttgcgagagccccgaccctcctatggaaagctgcaggagccctgggggaggccccaggagggccaactccgcagggcgctaagcctcagacaggggcaagagaagtccaggtcccagggcctcgagagaggcacagaagggccagatgccactgcccaggagcgggtgccggggagcctgggggacacagagcagctgatccaagcccagcgaagaggcagccggtggtggctgaggcggtaccaacaggtaagaagaaggtgggagagctttgtcgccatcttccccagcgtgactctgagtcagccggcctccccgtagcccacactgggcaccatcagctaaagatgctggaagccatcgtggcccccttgctgtgcctggaccagcccaccgtgtctgctgacctacctcttcacagctctctggactttggctgggtggccctaggaggcttctgccaccagctcactggagtcgccacgtggctgccactcttagctctggcccttccactccagcactagctctctttgaagatcccagcagggtcaaaaagaagggggctcagctgtctgccctctgggcttgggtaggggccttggactatgattctatgaaggtttagaagaagcctgcccggaatgggggctgtggacgctcctgccccacacgaccagctgtcaacttccaggacggagcttgatgaagccagacccatggccgagaggctcacggacgttgcctggtcactgggccatgacccaactgcccttcttgtcagttgctgatggtgggccagggcgcaggtctccctcccagatggtgagccctctggggcaaggaccacagctgggtggccctcctggctgagcactctgtgctgaaaacctttgaacctcacggtgtcctgatgaaggaagcagaggaagtcttcctccctgtgtgacagagggggaaactgaggcccagagtggggaagggatttcttggttttgacatctccgaccccaccccaccccatccagtgtccagcactggagtcgaacacagtaataaagatgctgagaaaaa

SEQ ID NO: 1230 - DNA, 712 bp, Homo sapiens
atggaaacgggacccagcgaagaacctagcggccgaaaagagtcccaggaaatgtgccccccgggattactggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaaggctaaaacaagagaagagattctccaactcttaagaaaacaaagagaagaaaggatctcgaaagaactgatttcccttccgtataaaccaaaagccaaagaacacaaagcaaagaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttc

SEQ ID NO: 1231 - DNA, 3099 bp, Homo sapiens
atggaaacgggacccagcgaagaacctagcggccgaaaagagtcccaggaaatgtgccccccgggattactggtatttgctggctcctcggaacaagatgccaacttggctaagcagttctggatctcggcgtcgatgtatccccctagcgaatctcagctggtgctgcgcagagacagcagtcagcgtctgccggtggcgcggcccaggaggagcagagggtctgaaaacagccactcctcgcagtcttttcaccttgcgagtaacaaaaatagagacatctttgccgaagccctaaagatacaggaatctgaggagaaagtaaagtatctccaaaagacaaggtctcactctgtcacccagaatgaagtgcagtggcatgatcatggctcactgcagcctcaactttctcggattcaggctaaaacaagagaagagattctccaactcttaagaaaacaaagagaagaaaggatctcgaaagaactgatttcccttccgtataaaccaaaagccaaagaacacaaagcaaagtaagtttacctatgtcaaaaatattctctcacctttcaacttactgtgtagggaagcatttcttttttcttactttgccacttacccttaaatcttctagaaacccacccgtgtattacagatttcttgccttgaataaactttcttctccgcacagctattaaagcctgtgtacgaacttgtctgtctgtggaatatgcaagcataagttagtgcaaaatggaaagcagctcagccttgaagctctgtgcacattctctgtccctctcttctcaccctgggctatataatcacccatcatcatgccctcctgactccactgtcccctatccacacctggcccacttctttagtgaatcagcacgtgtttgtggctcaccagctctgagtgggctaaggttgctaaaactaagttcatgtagcaaactctcaatgataagggagtagccttatctctggaataatgttagagcaggactaggaacagtttaacagtctagaagagtttaaaggaaataagtaagcaacagttaatcactaacgcacccctaataagaaatctgtccgtttttgtattatgactaaaaaccaatgtggccaactcaacattaatatgacaaatatttattttcataccacattctgggagaaacagaaagtgatagaattttgatttttctctcattggtattgaggctaactgcctttaatgctgtcaaagtaacacccttaaggaagaaagaatatgtctactctaattttgtaaacttctggaaaaaaaaatagaaagatcatttaatcacctagctatattatctacacaatgctcagcaacctaatttctcgctttttagccagacgatttgacttagcttccacagatgaagcaaaactagcccaatcaagagtgacttaacgataccaatagtggatgaagactgctacttaaatagcatcaatagatacgtctgggtgccttagatttccgcatgtatttttacagaacattcctgctactacccatgctgactcacctaataataaaacatttcccggcttggacagataattctcttaataatttaaatgcttacttaattccttttgtaaactaactttgtcctacatcctgaagccttgaatttcattctattctgttgtgattatcttcctactattaacttcttctagctactcttctttttttttttgagacggagtctcgctctgtcacctaggctggagtgcagtggcgcgatctcagctcactgcaacctctgccacccaggttcaagcaattctcctgcctcagccttccaagtagctgggattacaggcgcccaccaccatgcccagctaatttttgtagttttagtagatacagggtttcaccgtcttggccaagctggtcttgaactcctgctcgtgatccacccatctcagcttcccaaagtgctgggattacaggcgtgagccaccatgcctggcctctagttactctttgtacattctttgggcaactaatcatgcattactctgtgcccatattttataattatttaactcttattattgctttcattatttaacttttctcatattttttgtattgtctgtaactatactgtaagctccatgaggaattgggtcacccaaagtgccagcatactgcttacatgttggacttcagaaaatatttataacaaaaagtttagttgaaaaatatcatgtaattcagtgttagccaatttagaaagtgatgtttgcatactatacattaatttataaactttaaaaactattctattagacacaattgtaaaataactcccctacatacacagactcccccttaccattcctccttcaacaggtcttcttagtataatccaggtccccttctgttagaaagaaggaaccggaaaatgtgttcatagtaaggttttagtagcaatatatttattatccatcccagaatatttgcattttaaaagaagtctgaataaataaaataatgggtaaaccaaagaaatcaattaccaatgatgaaatctcaggagtctgactctagaataaacaaaacatatttggggtaggagggctcctgtacctccaaaccacacttcacaatatcataaccacttctctcacatacaagtttatacttggttgcaaaacccaacacatagaatctacaacagtgaatttttattgggagaattttcaaaagttgttttcatgctacatcatgttcacaatggcggagttctgtgtattggaactgactgatattactaccaacaggaaagtggtatcagagtcagataaagaggaccaagaagaagtcaaaactttggactaatttgcttgacacatggcagaggatggctcacttataccttcactttggaaacaaccttctcttagatcaggatcattgagatcactggcaacattatagtagacaaagaaatacaagttaaatacgcagacttccaggaattttaccagttagtgagtacttgtgttaaaataaagaaataaaggttaaatatgcaggcttct

SEQ ID NO: 1232 - DNA, 1710 bp, Homo sapiens
ggaggcaggttctagccccatccctggagggactcggcctctgtggcctcatttctacactagggtgatggtggggccaccccaaagtccccaaggcacagtcgagctcagcatgtccctggcaggttctgggtgctcaggaagcagaatactcaggcctccacacccctggccccaggtcctccttggaccacaggagacacaggcctcccacctcaggagggaggagggctggcctgaccactgtccctcccaccctaggacacagtcatgctcatatcggctgcgtcgatggcacccgaggtgtgcggcccaagcctccagggaacccctggacccccaccgcccctgctgcccaagccagggaaggacaacttgcgtttgcagaagctcctgaggaaggcagcccggaagaagatgatgggaggcacacacctcgctccacccagggccttccgcacctccctgtcccccgtgagtgaggccagccatgaccaggaggtcacagccccgcacgctgctgagggcccgcaccccgccgaagccccacgccttcctgaagccccacgccccgccgaggctccccgcatggtggctgccctaccccgctccccgcacacccccatcatccaccacgtggcatcacccctgcagaagtccacgttctccatcggcctcacccagcgcaggattctagctgctcaattcagggccatggggccccaggttgtagcctcggccccagaacctacccggccccccagtggcttcgtccctgtctctgggggtgggggcacccacgtcacccaggtgcacatccagctggcaccatccccacacaatgggacccctgagcctcccaggacagccccagaagtgggatccaacagccaggatggagatgccaccccaagtccccccagggcccagcccctggtcccagtggctcacatccgcccactgcccaccacagtccaggctgccagtcccttgcctgaggagccccctgtaccacggccgccacccggcttccaggcctcagtgcccagagaggctagtgccagggttgtggtgcccatagccccgacctgccgctcgctggagtcctcaccgcacagcctggtccccatgggccctggcagagagcacctggaggagcccccgatggctggccccgccgctgaggccgagcgagtgtccagccctgcctgggcctcatcccctaccccaccatcaggccctcacccatgccctgtccccaaagttgcacccaagccccggctcagtggctggacgtggctcaagaagcagctgctggaggaggccccagagcctccgtgcccagagccgcggcagagcctggagccagaggtgcccacccccacagagcaggaggtgcctgcccccacagagcaggaggtgcccgccctcaccgcaccccgggcccccgcctcccggacctccaggatgtgggatgccgtgctgtaccgcatgtcagtggcggaggcccaagggcgcctggcagggcccagcggtggggagcacaccccagccagcctcacccgcctgcccttcctgtaccggcctcgcttcaacgcccggaagctgcaggaggccacccggccccctcccacagtccgctccatcctggagctgagcccccagcccaagaacttcaaccgcacagcgactggctggaggctccagtga

SEQ ID NO: 1233 - DNA, 811 bp, Homo sapiens
cggggcctgagcgcgcgtctcccggcgcggggttcctcccacgcagaccctcattcaaacgatgccaaaggggcggcgcggcagccacagccccaccatgagccagcggtcggctccgcccctctatttcccgtccctgtacgaccgcggcatctcctcgtccccgctcagcgacttcaacatctggaagaagctcttcgtgccgctgaaggcgggcggggcgccagtgggcggggcggcgggggcccggtccctgtcccaggcgctccccgccccggcgcccccgcccccgccaccacccggcctgggtccctccagcgagcgcccctggccctcgccctggccctccggcctggcctccatcccctacgagcctctgcgcttcttctactcaccgccgccggggcctgaggtggttgcctcgcccctggtcccctgcccctcgacccccaggctcgcctctgcctcccacccggaggagctctgcgagctggagatccggattaaggagctggagttgctcaccatcactggggacggcttcgactcccagagctacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaaa

SEQ ID NO: 1234 - DNA, 555 bp, Homo sapiens
atgccaaaggggcggcgcggcagccacagccccaccatgagccagcggtcggctccgcccctctatttcccgtccctgtacgaccgcggcatctcctcgtccccgctcagcgacttcaacatctggaagaagctcttcgtgccgctgaaggcgggcggggcgccagtgggcggggcggcgggggcccggtccctgtcccaggcgctccccgccccggcgcccccgcccccgccaccacccggcctgggtccctccagcgagcgcccctggccctcgccctggccctccggcctggcctccatcccctacgagcctctgcgcttcttctactcaccgccgccggggcctgaggtggttgcctcgcccctggtcccctgcccctcgacccccaggctcgcctctgcctcccacccggaggagctctgcgagctggagatccggattaaggagctggagttgctcaccatcactggggacggcttcgactcccagagcttcttagggctctggaccacgtgtgctgatgcgggcaggatccctcagcctacgagctga

SEQ ID NO: 1235 - DNA, 5442 bp, Homo sapiens
cccttttctccgccttttccgcgctccatcttgccctcctccctccttcgcccccgctcctactctccccttcttcccctctctccctaccccctccctttctggggcaggcgtttctccgaggcgcactgaggctccggggcgagtccgcgcagcgcgagctggggaaagccgtccggggctcccgatgaccctgcactccgccgggaggccgcccttcggaaaagccgtggaaacacacccggattgaaatgcccctggcccgcctgacccgaccctaggagaagcagccgagttacccgacatcgtggtcagcaggagctgggtcggtggctggatgctgcagcagcagggactcagcgcctgggagggctcctggggcagggagagaagcagagatgcaacatttttaaaatttcacaaagcatccggctgcacccaggtccctggaacaggagacaaacagaattaatgttttataccttcgggtataggtttgagttttttccccctcatgccaagtatttaaaacctctagaaacccatgatttgacaatcaatgattgcgcgatactttcaatttgaatattcaaaggcttaacaaaatggactatcttctgcagaaatcctgcacacaggcaccccacagagagtccagagaaacagggagtgagacccctttgggtcctggcccttgcttttattatagtttgagcattttgtcctccttcccacagatagagcagatgtcctcaaagatgctctgtatttcagccttcagggcagctaagaagccatgagtgacttaggctgccctggccatgaacaccggagccagactggctggccagactgattcccgcatcccccatctgtgttttgaggggaaatctcaggttttgaggaatgaacatggcagctagtgggtgtggcacagcaagaagtcgctctgggcccaggtggcaggccagcggcctagcagaggccttcgctctgcacctcctatttttctggctccgcctggctaccagcgggcttccctccccctttcatcccgctcttcctgggcccgacactggggtttctgctcagaatgactgcccattaagaccctttcctcctccccacagagctggggatgccaggagcctcatcctctggagactttctgactctgggtttcaccaccgcactgcgaagtgccctctttgctttttcgccttctagagccacccctgcctttttgctgtaggagcacatgttaggaaacaatgacaagtttggctcctgctcattttaactgaaaggatgtggacttaggttcaagccttctcccattggggtgagaagggggagggacttgggatcaggcttcccccttggtccaggcccaagcccctcactaatgacttgggattctactgggtcatcttctgtgagtacttactgtgcctcttccatgtgatttggaaggtgaggagacaggaatggtccacagagggagagagtgccaggccaagtcctctcatagccacccgccccctccacagaaggggacagcaagagaagagagaggcatggtgaggttccttttgcaaataaccaagatatttccaggattcaagaccagtccatggttttaggcctctgctgtttattctctgagttctcagaaatgcaaaaagtgtagtttagccccagaggcctcaagaaaaagattggggtgcccccaaatgtgtcaaatacagagggaaacacacagagcttagggaaagggcaactgagaatgacaagactgataggaattgcttggcagctgaagccacatctctgggggagaggagcaggcctgggaacacctgaggtggcacctggcagtggagggcaggatggatgtattgaaatctgacagcttctggaacttctttctacaaatgcccctgagcctgtgtcctaggtttccctgatggaccagacctgaggaggggaaggacaatgggggtggagatggcacctcccctccctgcatgccttcttcctcgctgtgcctaggccttgccccctctgaaggaacagtgaaccaagcagcttggaatctagggatggtctcttgtcctcatagcgtcttccattacttcttttcttcgctgctctcctcctttttgttatactcttattttttgatttgcttttaaaaaccttctttgttgcatttttgtttatttctttctgtgtttctttgtctctcttcctgtcattgctttcttccatttcttatctgtactactggttttctccctggcttcacgtgtctctgtgttcccctatgctggggtgtcctcccagtgctttcaggcttcatctccttcctaacctctcctttctattttttttttttttttttttgagatggagtcttgctcagtcgcccaggctggagtgctaacctctcctttcatgtggagatggacagggatggcaggagcactgagtgctcttgacaacaccattgaagatgatgctgacgatcagctaccctgtggagaaggcaggccaggctgggtgagaggggagctccttggaagtcagggggtctgtaaggacagcaaggatctctttgtcccaacctccagcagcctttatgggtgcttctgtgttggccttgtttctgggatggccatctcagtgctgttgctggctagcgatttcagaaaactagatttttctaggcctgagccctgttttgagaaagaagcttccctctggtttgtagctcaacattaatgagttttggttcctgttgtttctataattacaaaaccccagcacaggtatttaagagccaaaggccatgcttgtggaagtaagggaggatctttctaaatggatcctgcaaatcctccttacagatctgagtggatgatcaggcccagagcaaccctgagaccccaggtacccacagcattggctgttcttcataggagactcagagaagacttcataggagactcattattgtttactggacatcaggtgctatattgtatagcattcacattccacaggtgaggaaacaggctcagaggaataagtggcatgccaagatcactgagtatatcagtagcagaattaggattcagactttgttaggcctaactccaaagccctggctttttttttttttgagatggaatcttactctgtcaccgggctggagtgcagtggcatgatctcagctcactgcaatctctgcctcctgggttcaagtgattcccctgccttagcctcctgagtagctgggactacaggcatgcaccaccacgcccagctaatttttgtgtttttagtagagaggaggtttcaccgtgttggccaggatggtctcaatctcttgaccttgtgatctgcctgcctcggcctcccaaagtactgggattataggcatgagccaccatgcccggcctttgctcttaactactgatgttgtcttcctgatcttttctacaagaagcttttaaactttttggactttaacctacaataagaaatccattttacatgttcacatgtatctataacaacatttatatttctaaaacaaacttttcatgaaacaagatatacctacatatgtcaggcactctgatattttctattctagtccaccttttccatttcattctatttatgggaaatatatgttggttgggagtcactgagttaatttaatgacccactaataggctgtgagtggcattggaaaaatacctgcttgtaagatatgcgaacacacgtttcaaggttgtttgtgcatgtggaaatattttggggtgctatctgttttaccatcagtttgtacaaggacactaagacagtgtagcctgctgacttgagaatgttctgtaaggactggaaacactagaatcttgaagaaacgcctggctagaggtgagggtaagctgttaattacactgattacagtttgtgcctctcagactgagaactcttttcttcttgctgggggcattgctatctctaggatgtttgccctgaagtcctgatagtctctttggggttttaataaatggctgaaaaaattgttgtggggtttcaacaggcgttcataggcacccttgcttggcaatataacatggcttttgatgtttgggtgttggaagggatctttgaagtgctgagagggactcagtctttttccaaaatctctgcttgtgtctgtccagcctctggctccactgcttggctgagatcctggcccatagtagaatctgtgtagaggaaacgagagctcactatttgtgaggcagcctgttccactattggactgctttaaatgtagtgatcagtgattatgctataatccaatcatgtattaattgggcaccaactatgcactaggcatggtatcaagtaccaggagtacaaaaataagtaaaccttgatttctgctatcaattactctcttctcctacttctgtactactgcttttctattgtgagtttgtttagttcattaattggtttattcattcattcaacaatcatatactgattagctactctgaccaggtccagtactaactctgaagaagttatgcccatcccatcttcaccccaagccttctccttttgagactcctcatccagtttctttagttcttcatatatcactgtttttcagatctctggctatccttgccattgacctcagaaatcctgtatttgaccttaaccttcttatacccagtccatacccaaagtgatggaaatggaatagatttctttttaaagttttaaacgaatattttgactgaaaaattttggcagtcttgtatgcaaatgacactgcagagcattgttttctcccccccacgtaggagattttattcaactaaggcacaggcatattaaaagactttcagtataaggaaaaggggtagtttattccctccaaatttgactacagctcgaaattgtctttattaatgcaaagttcttttgtcaccttgactttgggacactgttaccaaacctcgtgggaaatatcaagttccagaagattgaatacatgcaggaaacaaatgttttttgggccctagagtgaacatttggtccatatgaaaatgaccaggaagacaattaggtgaaggttttttaatgatttgtgctacgtcagtctcttcccataagacatattcaaagttttaacttttccttaagaggcttccatggggagcaagcatttgataattcatcctttaagaaaaacaccaccgtacactgcttgaagagttcctcttctattacttaaaacgtttttattgtgcaacatttaaggcatacaaaaacatataaagaataccatgatgaaaatctatgactgtattaccaagcttaagaaataaaacagttgagtgatctctc

SEQ ID NO: 1236 - DNA, 5496 bp, Homo sapiens
agacttttgagatggacttttgaaagagtgtttgagggaactgttaatgctggctgtactgacctgcagaagatggtgcaactgggtctgaaaggtggacactgctgcctccggaccgctgtcaaagcaagaatatcaccgtgaagcaggctgaaagaaatgctctgaagggaaagctaagacattttgatgaggactatgtttctttctgctataaggaaaagccgtggaaacacacccggattgaaatgcccctggcccgcctgacccgaccctaggagaagcagccgagttacccgacatcgtggtcagcaggagctgggtcggtggctggatgctgcagcagcagggactcagcgcctgggagggctcctggggcagggagagaagcagagatgcaacatttttaaaatttcacaaagcatccggctgcacccaggtccctggaacaggagacaaacagaattaatgttttataccttcgggtataggtttgagttttttccccctcatgccaagtatttaaaacctctagaaacccatgatttgacaatcaatgattgcgcgatactttcaatttgaatattcaaaggcttaacaaaatggactatcttctgcagaaatcctgcacacaggcaccccacagagagtccagagaaacagggagtgagacccctttgggtcctggcccttgcttttattatagtttgagcattttgtcctccttcccacagatagagcagatgtcctcaaagatgctctgtatttcagccttcagggcagctaagaagccatgagtgacttaggctgccctggccatgaacaccggagccagactggctggccagactgattcccgcatcccccatctgtgttttgaggggaaatctcaggttttgaggaatgaacatggcagctagtgggtgtggcacagcaagaagtcgctctgggcccaggtggcaggccagcggcctagcagaggccttcgctctgcacctcctatttttctggctccgcctggctaccagcgggcttccctccccctttcatcccgctcttcctgggcccgacactggggtttctgctcagaatgactgcccattaagaccctttcctcctccccacagagctggggatgccaggagcctcatcctctggagactttctgactctgggtttcaccaccgcactgcgaagtgccctctttgctttttcgccttctagagccacccctgcctttttgctgtaggagcacatgttaggaaacaatgacaagtttggctcctgctcattttaactgaaaggatgtggacttaggttcaagccttctcccattggggtgagaagggggagggacttgggatcaggcttcccccttggtccaggcccaagcccctcactaatgacttgggattctactgggtcatcttctgtgagtacttactgtgcctcttccatgtgatttggaaggtgaggagacaggaatggtccacagagggagagagtgccaggccaagtcctctcatagccacccgccccctccacagaaggggacagcaagagaagagagaggcatggtgaggttccttttgcaaataaccaagatatttccaggattcaagaccagtccatggttttaggcctctgctgtttattctctgagttctcagaaatgcaaaaagtgtagtttagccccagaggcctcaagaaaaagattggggtgcccccaaatgtgtcaaatacagagggaaacacacagagcttagggaaagggcaactgagaatgacaagactgataggaattgcttggcagctgaagccacatctctgggggagaggagcaggcctgggaacacctgaggtggcacctggcagtggagggcaggatggatgtattgaaatctgacagcttctggaacttctttctacaaatgcccctgagcctgtgtcctaggtttccctgatggaccagacctgaggaggggaaggacaatgggggtggagatggcacctcccctccctgcatgccttcttcctcgctgtgcctaggccttgccccctctgaaggaacagtgaaccaagcagcttggaatctagggatggtctcttgtcctcatagcgtcttccattacttcttttcttcgctgctctcctcctttttgttatactcttattttttgatttgcttttaaaaaccttctttgttgcatttttgtttatttctttctgtgtttctttgtctctcttcctgtcattgctttcttccatttcttatctgtactactggttttctccctggcttcacgtgtctctgtgttcccctatgctggggtgtcctcccagtgctttcaggcttcatctccttcctaacctctcctttctattttttttttttttttttttgagatggagtcttgctcagtcgcccaggctggagtgctaacctctcctttcatgtggagatggacagggatggcaggagcactgagtgctcttgacaacaccattgaagatgatgctgacgatcagctaccctgtggagaaggcaggccaggctgggtgagaggggagctccttggaagtcagggggtctgtaaggacagcaaggatctctttgtcccaacctccagcagcctttatgggtgcttctgtgttggccttgtttctgggatggccatctcagtgctgttgctggctagcgatttcagaaaactagatttttctaggcctgagccctgttttgagaaagaagcttccctctggtttgtagctcaacattaatgagttttggttcctgttgtttctataattacaaaaccccagcacaggtatttaagagccaaaggccatgcttgtggaagtaagggaggatctttctaaatggatcctgcaaatcctccttacagatctgagtggatgatcaggcccagagcaaccctgagaccccaggtacccacagcattggctgttcttcataggagactcagagaagacttcataggagactcattattgtttactggacatcaggtgctatattgtatagcattcacattccacaggtgaggaaacaggctcagaggaataagtggcatgccaagatcactgagtatatcagtagcagaattaggattcagactttgttaggcctaactccaaagccctggctttttttttttttgagatggaatcttactctgtcaccgggctggagtgcagtggcatgatctcagctcactgcaatctctgcctcctgggttcaagtgattcccctgccttagcctcctgagtagctgggactacaggcatgcaccaccacgcccagctaatttttgtgtttttagtagagaggaggtttcaccgtgttggccaggatggtctcaatctcttgaccttgtgatctgcctgcctcggcctcccaaagtactgggattataggcatgagccaccatgcccggcctttgctcttaactactgatgttgtcttcctgatcttttctacaagaagcttttaaactttttggactttaacctacaataagaaatccattttacatgttcacatgtatctataacaacatttatatttctaaaacaaacttttcatgaaacaagatatacctacatatgtcaggcactctgatattttctattctagtccaccttttccatttcattctatttatgggaaatatatgttggttgggagtcactgagttaatttaatgacccactaataggctgtgagtggcattggaaaaatacctgcttgtaagatatgcgaacacacgtttcaaggttgtttgtgcatgtggaaatattttggggtgctatctgttttaccatcagtttgtacaaggacactaagacagtgtagcctgctgacttgagaatgttctgtaaggactggaaacactagaatcttgaagaaacgcctggctagaggtgagggtaagctgttaattacactgattacagtttgtgcctctcagactgagaactcttttcttcttgctgggggcattgctatctctaggatgtttgccctgaagtcctgatagtctctttggggttttaataaatggctgaaaaaattgttgtggggtttcaacaggcgttcataggcacccttgcttggcaatataacatggcttttgatgtttgggtgttggaagggatctttgaagtgctgagagggactcagtctttttccaaaatctctgcttgtgtctgtccagcctctggctccactgcttggctgagatcctggcccatagtagaatctgtgtagaggaaacgagagctcactatttgtgaggcagcctgttccactattggactgctttaaatgtagtgatcagtgattatgctataatccaatcatgtattaattgggcaccaactatgcactaggcatggtatcaagtaccaggagtacaaaaataagtaaaccttgatttctgctatcaattactctcttctcctacttctgtactactgcttttctattgtgagtttgtttagttcattaattggtttattcattcattcaacaatcatatactgattagctactctgaccaggtccagtactaactctgaagaagttatgcccatcccatcttcaccccaagccttctccttttgagactcctcatccagtttctttagttcttcatatatcactgtttttcagatctctggctatccttgccattgacctcagaaatcctgtatttgaccttaaccttcttatacccagtccatacccaaagtgatggaaatggaatagatttctttttaaagttttaaacgaatattttgactgaaaaattttggcagtcttgtatgcaaatgacactgcagagcattgttttctcccccccacgtaggagattttattcaactaaggcacaggcatattaaaagactttcagtataaggaaaaggggtagtttattccctccaaatttgactacagctcgaaattgtctttattaatgcaaagttcttttgtcaccttgactttgggacactgttaccaaacctcgtgggaaatatcaagttccagaagattgaatacatgcaggaaacaaatgttttttgggccctagagtgaacatttggtccatatgaaaatgaccaggaagacaattaggtgaaggttttttaatgatttgtgctacgtcagtctcttcccataagacatattcaaagttttaacttttccttaagaggcttccatggggagcaagcatttgataattcatcctttaagaaaaacaccaccgtacactgcttgaagagttcctcttctattacttaaaacgtttttattgtgcaacatttaaggcatacaaaaacatataaagaataccatgatgaaaatctatgactgtattaccaagcttaagaaataaaacagttgagtgatctctcatttatgactaaattaacttattaaaaccattaaaacttttggattattcctgttaa

SEQ ID NO: 1237 - DNA, 375 bp, Homo sapiens
atggagtcttgctcagtcgcccaggctggagtgctaacctctcctttcatgtggagatggacagggatggcaggagcactgagtgctcttgacaacaccattgaagatgatgctgacgatcagctaccctgtggagaaggcaggccaggctgggtgagaggggagctccttggaagtcagggggtctgtaaggacagcaaggatctctttgtcccaacctccagcagcctttatgggtgcttctgtgttggccttgtttctgggatggccatctcagtgctgttgctggctagcgatttcagaaaactagatttttctaggcctgagccctgttttgagaaagaagcttccctctggtttgtagctcaacattaa

SEQ ID NO: 1238 - DNA, 1414 bp, Homo sapiens
actatctccaggcgtccaggctgaacgcgcggtcaccctcggccgccgcacccagcgcacttcccggcgcgattcctggacgcacactgcagggtagtggtcagggccggagccgccccggactcctgcggccacctccaccttgaaagctcgcccggctcggcttggcctaacagccagtccccaacctactcactgcggcttttcggggcccggggctgaggctgcccctgctcccagcgctcaggggtccctcccagcgaacccctcttgagcgcgcccgccacctcccgcgagccggggcagtccgaccgggccccgccagccccggggcggcccctaccgaagggcggcctcccggcggagtgcagggtcatcgggagccccggacggctttccccagctcgcgctgcgcggactcgccccggagcctcagtgcgcctcggagaaacgcctgccccagaaagggaggggaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgcatcgtgtgaggcagaggacttggatgctctccaggcagcagagtacttctacccgagcacagactgtgtggactttgccccctcagcagccgccaccagtgatttctataagagggaaacaaactgtgacatctgctatagttaatagaaattacagtaattcagaacatggcatgggtatatctatttttctaccacgtctagatgacactgcaaaatatgcaacttggtaacacaatatcccaagcacagtttacatgtcactatttccaattttctgatgctaagcattcatatgaagtcctcagacccggtcacagcgccactcctactttg

SEQ ID NO: 1239 - DNA, 1332 bp, Homo sapiens
agaggggaagaaggggagagtaggagcgggggcgaaggagggaggagggcaagatggagcgcggaaaaggcggagaaaagggacgagggagagcgggcagaaggcaaagacagaagggagcgagggagggagttcctcgggcctggcccctttactaggtcagtctggcaggtacctcgccggcccaggacggggctggccaaacctcaccgcttgctcccgggctggcttccagaccaagggcacgcagaggtcggagcctgcccagaagccacacctggccagaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgcatcgtgtgaggcagaggacttggatgctctccaggcagcagagtacttctacccgagcacagactgtgtggactttgccccctcagcagccgccaccagtgatttctataagagggaaacaaactgtgacatctgctatagttaatagaaattacagtaattcagaacatggcatgggtatatctatttttctaccacgtctagatgacactgcaaaatatgcaacttggtaacacaatatcccaagcacagtttacatgtcactatttccaattttctgatgctaagcattcatatgaagtcctcagacccggtcacagcgccactcctactttgtatgctcatagtttaaatttttgtaggaaactttcaattgttttactttttgtataacgaacaaatgctgtctccttttttactaataaataattttgtattactaa

SEQ ID NO: 1240 - DNA, 823 bp, Homo sapiens
tcccacgtatccactgttgtgtcctgagacacgcggtgcggaccctgcgcgcccagaagctgctacggggggagctagaggctcacagtgagcctgggacgggggcagagcgcaccgactgcactgagccgagctgtggcggtccctgcgcggaccccgaggggcgcccgctgcccgcggagtccggagccgatcggggaacggggtggtggggctgcgaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgc

SEQ ID NO: 1241 - DNA, 1308 bp, Homo sapiens
atgggaaacaagcagccccagaaggtcacggtgcctactgggacagccctccaaggagtggtattgatcgtctccacgctgcaccagccaggtggctggatatgtggcaaggatccctgctgcagcttgaggccactttcaaactctgtacagaacgccttggcctgcaagagtaaacaagattaccaggctggaattctgttcaagaccagggcttttatatccagagattgtgggtcagatgcggcagaagactctgcttccaagggagagacttatactttaaccttggagcataagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcggggggcgggcggcgccggggaaggggccgttactttcccagagcggcggggcgacgtcaggcggaagggcgcggggcgcgcacgctttaaatggcattcgctgtcatccgagctcagagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaa

SEQ ID NO: 1242 - DNA, 1834 bp, Homo sapiens
agagcggcggggcgacgtcaggcggaagggcgcggggcgcgcacgctttaaatggcattcgctgtcatccgagctcagagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacagtgcagttttccaggctcttgactttttgcaccttcggggtccaggctcccaagactcggggaggtgggggaggaggtggcagggggatgtcggaccagggagccgggagtggagctacctccacaagcttcggtcaccggaacgaggttgcgccaccggtgcgcgggtcggttgcctgcctccccaagtggatccacccccggtccagtgtgctcctgcgtccctggtctattccccatcgccggcatccgggctgaagtgaagccgcaggaggggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagag

SEQ ID NO: 1243 - DNA, 1582 bp, Homo sapiens
gagaaacgcgtcctgagaaaaaaggggaggggcgagggagaggatttgcgcgtgcgcaaaagtagttgatggaaatcggccgttgggatgctgtctaagcttggatacctgagtaataacggacaacagataaagctccgcatccttgcgccacgtgcttcggtccgtggtttgcgtgcagacgtttgacctgtatggtgaccctcgcgatttgcaaatgtgctgaggatctggaatactgaagtggaaggcacctcttgttttggggagcatgtatatttccctcctgtgacgcactgcttccacagagaggtgcaaacgtgcaaacgctcagcgaccgcagcgctcctgcccctcccccaccgtaactccggggtcgcggatctgcccgccccgctctcccgaagctgttcgggcagtgtccgaacggcttcggaggggcgagaagccagcatccgagccgcctctccggaataccagcagcctgacgcacgcgtgctgtcgggggagggatgctgggacagctgctcccgcacacggctcgcggtctcggcgccgcggagatgcccggccagggtccggggtccgactggacggagcgtagctcttctgcagagccgcccgctgtggccgggaccgagggtggcggcggcggatcagctggatactcttgttaccagaattccaaaggttctgatagaatcaaagatggatacaaagtgaactcacacatagctaagctgcaagagttatggaaaactccccaaaatcaaacaatccacctctctaaatcaatgatggaggcgtcctttttcaagcatccagacctcaccacaggccagaagcgttacctgtgcagcattgctaaaatctataatgcaaactatctgaagatgttaatgaagaggcagtacatgcacgtacttcagcacagctcacaaaagccaggtgtcctcactcatcacagaagccgccttagctcccgttactcacagaaacagcattacccttgcactacatggcgacatcaactggagagagaggactcggggtcttctgatatcgcagctgcatctgcacctgaaatgctcatacagcattccctttggcggccagtgagaaacaaagaagggataaaaactggatatgcatctaaaacaagatgtaagtcactgaagatttttagaagaccaaggaaactgttcatgcaaacagtttcttcagatgattctgaatcacacatgagtgaagaaaaaaaggaagaagatttactaaataattttatgcaatcaatgtcaattgaagaacagggagaacatctgatgttaacttgacagtcttgtctcgtgtattgaattcgtgccaaaggtgagggtaaggggttgtgagttgtgtcctgtatgtttaggatggtattgttatttattaaatcattaagtaattttggtttgttcagaaacttaaaacaatgtaattggtctgatgtagttccatgtaccaatgatagttatgtaagaaaatttacatgtaacatatacttgtacttctagctagatacaattaaaacttttcttgcattcaa

SEQ ID NO: 1244 - DNA, 2093 bp, Homo sapiens
gctaatttgggccgagctggcgcctcacggccatgtttgcgccacctacagcctcggagggtgagcgtcatggcggcttcttgccctctcccggtgaccccggacctgcccacgctgcgtgccaagttgcagggactgctgcagttcctgagggatgccctgtccatttccaatgcacataccgtggatttctacacagaatccgtgtgggaggagctggtcgacttgccaccggagacagtgctggctgcgctgaggaagtcagcgtcggagacggaggccctgccctcagagacgcgccccctagtggaagcagagtgggaagcaggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttatgaatatgaagaaatctcatgaagttcaggcaatgtcagagctgatcagcagtattgctgactactatggaataaagcaggtgattgacttgggttccggtaaaggctacctaagctcttttttgtccttgaagtatggcttaaaagtttatggaattgattcttcaaataccaatactcatggagctgaggagagaaacagaaaattgaagaaacattggaaactctgtcatgctcagtcaagattagatgtcaatggactagcattaaaaatggcaaaagaaaggaaagtgcaaaataaagttaaaaataaagctgatactgaggaagtgtttaacaacagtcctacaaatcaagaaaagatgcctacctcagctattttgcctgatttttctggctctgtaatttctaatatcagaaaccaaatggaaacccttcattctcagccacatcaagaagaaaatttgtgttttgaaaattccttttctcttataaaccttttgcctattaatgctgtagagcctacttcttcacagcaaatacccaacagagaaacatctgaagccaataaagagagaagaaaaatgacatcaaagtcaagtgaatcaaatatatattcacctttaacctcttttatcactgctgattcagaactccatgacattattaaagatttggaggattgtttgatggtgggtctccacacttgtggtgatctggctccaaatactttgcgaatatttacctccaactctgaaatcaagggagtttgcagtgtgggttgttgctaccacctcttatctgaagaatttgaaaaccagcataaagaacgtactcaggaaaagtggggatttccaatgtgccactatttaaaggaagagagatggtgctgtggtcgtaatgccagaatgtcagcatgtttggcattggagcgggttgcagctggccaagggctgcctactgaatcactcttctatcgtgctgttcttcaggatattattaaagattgttatggcatcaccaaatgtgatcggcatgttggtaaaatttattccaaatgttcttcttttctggattatgtcagacggtctctaaagaagcttggattagatgagtccaagctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacagaaggttataatccatttttccattgtcaaagcatacattaataaaagaagaacctgtcataataatata

SEQ ID NO: 1245 - DNA, 1237 bp, Homo sapiens
aatatggaacagaaagctggcccggctaaagcggctcagtagttggaagtcatcagccagtgaagcaagcacaatcagcaaatctagcagagccgttagtgcatcttctccaagaagggccgttcataaaaaaaacaacaaggtttatttttcaggaaaaagacaggcgtgtcctaattgggttttccagaccttggttataactctgattgctgtgatggcattttgtgctttgacgatagttgccctctatatacttagcttaaaagatcaagaccgacgtgtcccaaatctccctccaagcaatatcacaagctcacaggagccagctctgctgcccacagcctcctcctcagcacctaatacatccctggtaaccacaccggcctccttacaagtacctgaaattactttctgtgaaatcctgccgtgtcaggagacttattgctgccccatccggggaatgaaagaagtctcttcaagtcctgtgcaaagacaatctgaggagaaggaattccatcagaggcgatggtcagaagacaaaagcaaatcagttttggcaagaaatgcactcagcggccctgactgggagagtgactggattgatacaaccatcagttctattcagattatggaaatccagcaaataatagatcatcagtattgcattcaaagcctccagtgcggatctggaaattataattacaatattcctgttaataaacacacacccaccaatgtcaagttctctctggaaataaacacaacagagccattgatagtcttccagtgcaaattcacccttggaaatatatgtttccatagtaaaaggggaaccaaagggctggaaagccacagagaaatctcccaggagatgacacagggatatcagcacatttggagcctccctgtagccccattttctgacagcatgttccatttccgtgtagctgcaccggatttagctgactgttcaactgatccttattttgctgggatattcttcaccgattacttcttttacttctatcgacgctgtgcctaatttgttcaagtttggggactttaccaaagaaaaatactcaggaatacatttaacagaaacgaacatcctcttgcaacttcttttttcttctttgtaaaacatttacgtttattgctgaaggactttttcaggctttagcttccaacagttttgagacattaatgaggagaataaaatgtttgctgaaacttg

SEQ ID NO: 1246 - DNA, 2919 bp, Homo sapiens
gaaggcgccgcggccaggaagccgcttctggacgggcgttcccgcccctcgctgggcttggtagttggggcgcagccgcggtggctgggcgcggagtgtgcgtggcctgagccgtgcgggtgactgcttcagggcttctccgcgactggaccgggcgccgctcgaaagcacgccctccattcgcactgcttgttgggctcatcatgaagcgcttgggctccgtgcagcggaaaatgccgtgtgtgtttgtgacggaggtgaaagaggagccttcctccaaaagggagcatcagccatttaaagttttggcaactgaaactgtaagtcacaaggcattagatgcagatatatacagtgcaattccaacagaaaaagtggatggaacatgttgttatgttactacctataaagatcagccatacctttgggctcgactagatagaaaacccaacaaacaagctgaaaaaagatttaaaaattttctacattcaaaagaaaacccaaaagaatttttttggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacccatatgggttagggagcaagaaacatccattacatcttcttataccacatggagcatttcaaataagaaatctaccttcattgaagcacaatgatctcgtgtcctggtttgaagattgcaaagagggtaaaattgaaggaatagtgtggcattgcagtgatggctgtttaataaaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaatcttgaatattctaccatatttaaaaatatctcaaggtttctgttcattatgaaacatcaatatgttttctaccatttgtgaagaaatgaattttccagtttcaagtacctattcaaaattttattaaaaaccagcaaattaattttaatctctagccataaaaacataagtaatagtaagctcctaagcttggacaaaggctggattctcttcactataactgagtggtaatttaaagacaacaatttaatgtcactaattttcaaaattaaatagtttaagctcaatttaattttgctagatatttaacaaaacatacggctcaacctcataacctatatgtgtgtatgtctacatctgtgtatatatcataggatttgagaatcttaacacatgtataaataagtatatataaactccaattttaaatcttaaaattgctgaatttaccctcatattctttaaaaaacttaaagcattatgaatgtagagaaattcaccagagctcactgcctatttgatggctgtaacaagtcttcaagtatatacttttataataagttgaaaatttcatataattttatttattaagaattccaatctaagtataaaggtacaaggtagtgagaaggaaatactacagttcggagaactgcttatttccaagtatatttaacttataaagttaataaatagttaaatgaaacaaagtttataggtgacctttagtaaatggggaaattaacaggactttcttcttcatcttcaaactcttcagaagcagcaacagggctagttaattcaactcccaattgttctgaaagtttttttaccttctcttctaagagaatattcttcttcacttcttccttgtaattatacttaagatcttcaatttcttcaaaaaatgaaggatcaaaattttccagttcttttttcagcttctttatttcctcctaatggaaacattatctttaaaagttgcatataggaaatatacatattttacgtttgaacaaggagatttaattgtaaatatgaaagccaaagtattcctgaatggtcaaatacagcaataaaggcagaagaattaagatttttctttgttccattgtacagtgtaaataactaagttgttaactgtcaagtccagttatgtattctgtaagttgtgttctagtctttgactaaaatttatcatctcttataatgggacttaatctttctctaaaagcatataagagcttgtcaatagagcaatcaatcaaaaagattttgtgattcataacattgaagttagtctggttaagagttttggtttagacttcatttatattttccttactaatatctaatatttaatgaataatgatcaattttttataaagttattaatatgatcagggaaacctttgggacttctgacaggcatctggtgaagagacaattcaagccttagtgactatttagaatagccagtgatcactagctaattctcatatccatgcctttttgtcctgtttacagtcttaaaagaggtaaaacagcaaatatttttttaagggaactataaccttaggattcctgaaaagaatttcaaaaaaaaaataaagacactgttgccaatgtgacccaaaacttaagaacatactaatggcatatatttgttacaattaaaaaataaatttactacttaatccta

SEQ ID NO: 1247 - DNA, 2731 bp, Homo sapiens
actttctaaatcacagtgcctgtggccggatgacatggagggagctccctgaccataggaggggttagagacacgacgcccctctaccctcactcacagcagaggtggaaagctggagactgacccacacatggagcgcaccccactggggacccccagctcagccatgctggcctgtctgcagaggacccagaacgccccgggccaacacctggcctgcccgagcaagagcctggagctgcgcaagtgcgaggcggtggccagcgccatgcattcctcccgctacccgagcccagcagaactggacgcctatgccgagaaggtggccaacagcccgctgtccatcaagatcttccccaccaacatccgtgtgccccagcacaagcacctcagccgcacagtcaatggctatgacaccagtggccagcgctacagcccctacccacagcacaccgctggctaccagggccttctggccattgtcaaggccgcggtttcctcctccagcacggccgcaccagctgggcccgccaaaagtgtgctcaagagcgccgagggcaagcggaccaagctgtcaccggccgccgtgcaggtgggcattgcgccctacccagtgcccagcactctgggtcccttggcctaccccaagccacctgaggcgcctgctccaccacccggcctgcccgcagccgccactgccgcctccgtcatccccctgccgggccggggcctgcccctgccaccttccaacctgccctccatccacagcctcctgtaccagctcaaccagcagtgccaggccccgggcgccgcaccccctgcctgccagggcatggctattccccatcccagccctgccaagcacggcccagtgcccagcttccccagcatggcctactcggctgcagccggtctgcccgactgccggaaaggcactgagctgggccagggagccacccaagccttgacgttggctggggccgccaagcctgcagggtacgcagacagcggcctggattacctgctgtggccgcagaaaccgcccccaccgccgccccagccactgcgtgcctacagtgggagcacggtggccagcaagtcccctgaggcttgcgggggccgggcatacgagcgggccagcgggtcacccctcaactgtggcgtggggctgcccaccagcttcaccgtaggccagtactttgcggccccgtggaacagtgtgctggtgacacccaccagcgactgctacaacccagcggcggcggtggtggtcacggagctggggccgggggcagcccgggagctggctgggccccctgcagatgccctctcgggcctgcccagcaagagtgtgtgcaacacatcggtgctgagcagcagcctgcagtcactggagtatctcatcaacgacatccggccgccctgcatcaaggagcagatgctgggcaagggctatgagacggtggccgtgccccggctactcgaccaccagcatgcccacatccgcctacccgtctacagataaggcctgccctgcggacatacggacatgcggacagggcgcagagccgggaggcaggccgcagaacagggtgggcggctcgcaggggcgctcagccccaccctgtgcctgctgatgcccacaggggagccaggctggctgccgcctcgctgtggccggatggagggtggcagggcaacctcacataccaaggcccctccccaccatcggttgccccaggacacagtgagggcctgggggcagccactgacgcccatgccttcctttatctaagctggcagaggcagggagagagaaaccactcaaaaacaggaatggttctttctgggcctcctgggacaggggcccaggccaaggtggggtgcaggaggaaacaggcgcaccagagtcagggtgggggcagggcagcccccccaggggtcaggcagctgtgtctccccacactggctccccagtattctggaaaaggggtacaggaggccgataggaagtcactgggcccaaagtgtctccccaccagccaggtgaagaccactctgacagaggctccagggactataccagtccccctgttcctccttcccctacccccaccattccttcctaacacagagttgcacccccatccccattctccaaaccctggactaccatattcccccttccctccaatacatcttatagggctgctgggtacagttgttcaggctgtgcactgcacaagggcaccttgtccaaggagacaccactttcacccaaacttgtatatttattacaattttctgcatcttgaggaaggggcgtcattttcctgttcgcacaaaggcaccacaggggctaacagtgggcctgcaatcttagatcccatccttgccttcttcgagggatctcttgggaccctcctggttttaactgggaggcccagaccaactcctttcctgcaaaccaccctccaaggcctgtcccacacgatcaaggcagggaaagataggcaggagtcccctcacgaagtcctcaagtcctggcccctctggcgctctggaagcggtactgtatctctctccaaggcctggtcaagcactaagtgcatttacaaatctctgagaatgttttttttatactaaaattgaccattatattctactgtgagaagtgcagtctgcactatattgttttaaaaacgaagagaaagaagaaaaaggaaaacac

SEQ ID NO: 1248 - DNA, 3294 bp, Homo sapiens
cgctgttcgccggcttcccctccccccacacccggggctcagagcaggaggaggaggggccggtgcattctcgccgctgttctttgcaacctgcaggggccggtgtatgtccggcgaggagccggggccgctgcgggtgcgtgcaacccccgaaggagacaatccctccacctcggggcgaacccgggggctgcaagccgcgggcgggcgggcgagcgagaggaagcaacaaagacaggctgcagctggggctggcgaaaggggccgcggccgccgggctcccagcgcgggcggagagggcgccctgggagcggcgcgggccgagctgcagccttgagcggggccccgaggggaggcgcagcgccgcccgccggacgtggcgatcacgggccccggcgaagatgcgtcgcctgagcgcccgcgcggcccccgtccggggcgggcgtgacccctgctgaacggagacctcccctcccccccgacttcggacggcgcaggccggcgccaggatagccctcaccgacagcgccccttcccacccggagagaggcatcgacccccaaggagggcttcgtcaggcagcctctgccactcctgcatggctgcgacccgtcgagcggagcgtcgtggtagctgagacctggtgcccttcgacggcctggctgatccgggacccagtcgcagagcgcaccccactggggacccccagctcagccatgctggcctgtctgcagaggacccagaacgccccgggccaacacctggcctgcccgagcaagagcctggagctgcgcaagtgcgaggcggtggccagcgccatgcattcctcccgctacccgagcccagcagaactggacgcctatgccgagaaggtggccaacagcccgctgtccatcaagatcttccccaccaacatccgtgtgccccagcacaagcacctcagccgcacagtcaatggctatgacaccagtggccagcgctacagcccctacccacagcacaccgctggctaccagggccttctggccattgtcaaggccgcggtttcctcctccagcacggccgcaccagctgggcccgccaaaagtgtgctcaagagcgccgagggcaagcggaccaagctgtcaccggccgccgtgcaggtgggcattgcgccctacccagtgcccagcactctgggtcccttggcctaccccaagccacctgaggcgcctgctccaccacccggcctgcccgcagccgccactgccgcctccgtcatccccctgccgggccggggcctgcccctgccaccttccaacctgccctccatccacagcctcctgtaccagctcaaccagcagtgccaggccccgggcgccgcaccccctgcctgccagggcatggctattccccatcccagccctgccaagcacggcccagtgcccagcttccccagcatggcctactcggctgcagccggtctgcccgactgccggaaaggcactgagctgggccagggagccacccaagccttgacgttggctggggccgccaagcctgcagggtacgcagacagcggcctggattacctgctgtggccgcagaaaccgcccccaccgccgccccagccactgcgtgcctacagtgggagcacggtggccagcaagtcccctgaggcttgcgggggccgggcatacgagcgggccagcgggtcacccctcaactgtggcgtggggctgcccaccagcttcaccgtaggccagtactttgcggccccgtggaacagtgtgctggtgacacccaccagcgactgctacaacccagcggcggcggtggtggtcacggagctggggccgggggcagcccgggagctggctgggccccctgcagatgccctctcgggcctgcccagcaagagtgtgtgcaacacatcggtgctgagcagcagcctgcagtcactggagtatctcatcaacgacatccggccgccctgcatcaaggagcagatgctgggcaagggctatgagacggtggccgtgccccggctactcgaccaccagcatgcccacatccgcctacccgtctacagataaggcctgccctgcggacatacggacatgcggacagggcgcagagccgggaggcaggccgcagaacagggtgggcggctcgcaggggcgctcagccccaccctgtgcctgctgatgcccacaggggagccaggctggctgccgcctcgctgtggccggatggagggtggcagggcaacctcacataccaaggcccctccccaccatcggttgccccaggacacagtgagggcctgggggcagccactgacgcccatgccttcctttatctaagctggcagaggcagggagagagaaaccactcaaaaacaggaatggttctttctgggcctcctgggacaggggcccaggccaaggtggggtgcaggaggaaacaggcgcaccagagtcagggtgggggcagggcagcccccccaggggtcaggcagctgtgtctccccacactggctccccagtattctggaaaaggggtacaggaggccgataggaagtcactgggcccaaagtgtctccccaccagccaggtgaagaccactctgacagaggctccagggactataccagtccccctgttcctccttcccctacccccaccattccttcctaacacagagttgcacccccatccccattctccaaaccctggactaccatattcccccttccctccaatacatcttatagggctgctgggtacagttgttcaggctgtgcactgcacaagggcaccttgtccaaggagacaccactttcacccaaacttgtatatttattacaattttctgcatcttgaggaaggggcgtcattttcctgttcgcacaaaggcaccacaggggctaacagtgggcctgcaatcttagatcccatccttgccttcttcgagggatctcttgggaccctcctggttttaactgggaggcccagaccaactcctttcctgcaaaccaccctccaaggcctgtcccacacgatcaaggcagggaaagataggcaggagtcccctcacgaagtcctcaagtcctggcccctctggcgctctggaagcggtactgtatctctctccaaggcctggtcaagcactaagtgcatttacaaatctctgagaatgttttttttatactaaaattgaccattatattctactgtgagaagtgcagtctgcactatattgttttaaaaacgaagagaaagaagaaaaaggaaaacacagatggtgtctca

SEQ ID NO: 1249 - DNA, 6228 bp, Homo sapiens
gacttaaactctggggcccgggaggccgccggttttctccccgcttgccggggtggtcctcttccctttgtcggaccaaagaagtaaacactgtgtggagagggactgacgtgtttggagggaaatgggaatgtacacgataattaaagagtaaagttgtgctcaacgctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccaatttcacagccactgctgaatatccaaaattatcctcaacaaatttctgtttctgatatgcataatgggacagttgtggcctcacacacttcagtagaaagaataacatatgcaaatgttaatggacccaaacaactaactcacaatttgcagatgtcttcaggagttacccaaaacgtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaattctacacgacttcctgtagcttaccaaggaaatcagggacttaaccagtctttttcagagcaacaggttgattggacacaacagtgtatatctaagggactgacttacccagattacagaccacctccaaagctataccgttactcaccacaaagctttttaccagattctaccattcaaaaacaaaactttataccacatacatcattgcaagttaaaaatagtcagcttctaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacagcaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagactcatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaact

SEQ ID NO: 1250 - DNA, 2326 bp, Homo sapiens
attcctaataccttaagtgtacttgtaagtgaagagcaaagttggaggctgttgagctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccaatttcacagccactgctgaatatccaaaattatcctcaacaaatttctgtttctgatatgcataatgggacagttgtggcctcacacacttcagtagaaagaataacatatgcaaatgttaatggacccaaacaactaactcacaatttgcagatgtcttcaggagttacccaaaacgtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaattctacacgacttcctgtagcttaccaaggaaatcagggacttaaccagtctttttcagagcaacaggttgattggacacaacagtgtatatctaagggactgacttacccagattacagaccacctccaaagctataccgttactcaccacaaagctttttaccagattctaccattcaaaaacaaaactttataccacatacatcattgcaagttaaaaatagtcagcttctaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacagcaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagactcatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaac

SEQ ID NO: 1251 - DNA, 362 bp, Homo sapiens
ggaccccacttgacttaaactctggggcccgggaggccgccggttttctccccgcttgccggggtggtcctcttccctttgtcggaccaaagaagtaaacactgtgtggagagggactgacgtgtttggagggaaatgggaatgtacacgataattaaagagtaaagttgtgctcaacgattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaaca

SEQ ID NO: 1252 - DNA, 2750 bp, Homo sapiens
gcagacttgaatagaactaaaaggaagaggaagggcaaatttgttggctgcttgagctgggatattcatctttctcctgatcttggacatcagaactcctgattctcaagcctttgggtttggactggaggcaccagctttcctgggcctccagcttgcagatggcatatcatggaacttctcagcctccaaattcataactctaatacaccagtacaatggaaagattcctaaattcaaaagccagaaggctgggttcctgttcccaccctgccttttaccttctgtgtgttcctgatgaagacacttcatgctccactatttacttacctctgaaacgaagggctgacccagatcagttgttctctgacctgcttggagggactcagaggctgtggagcaacagatttgggaatgaggaatcgttccctggaagagtcagagcgctcgtagacacattctgctggattgcacgagctcctcccctgggaaatccactaagactagaggaaagaattgcttggaggattcagaggctgaagagtggacagacggctttaattgagaaaaagaagcagaaaattgaggaagatgtgaggcatcaatgccagcagacgacatgtgacaggtgctagccacatggatcacactaaatttctgtcatttatatagataaaaaagaatttccaaagagctcctccataattcagcattaaccagctttaaatcatcacctttctttaccttttcaaagcacttttatctagctagctttcactttcagagtggccaattcaggtgaggattctcaatcctgttctgcagctgaggaactcatgctcaaaagggctaagagtttattctcttacatccaaacaccttgcttttccaaatcttgtgctcactttacctacacattttgatttttccaggctgatgacaagttagacatgcagactcctcaggctcattcataatctgtatagacattacaggtcatgcaaatttaagaaaaggctaaaaggtgcccgtttgcacccaacatgttggataatgccccggtaaagtggaaaatcagtttccacagcctcgctctgtaggtttccttggaattgtaaaagcataggactctgcctcatatttatttctatacggcaatgaggatataaaggagcagaccgaaaagagaaaggaattttaaaagccatggaaagctgccctaaatgtggttggatatagagaggagagtgctgaaggcaaacagctgtgccctctttgcctttttgctgaggaaggggatttaagccaaaagaacacacgtaaacgtggatttcttaaagttctcactgtaattatgtagccttgggagatgaggaattgtaaagtagatgctggcttaaacaaatgataaatccttgaggtgatgggcaccccattttccctgatgtgattattacacatagcattcctgtatcaaaatatcccatgtaacccataaatatatatacctaccagtatatttctgtggctaatctgaaagccacctgcacccttgtgaagacacccacagagacttctgcctcccctcctaccctctggcctcaagagctccctgggctctcctgttgcaggagggagagggagagcttctttaggttcctggtaaggatctctgaagacaattccttaggcttggataattcccagacatttgctaaaaagcagcatcctccaaagctttaatttggatcacaggaaaatgatgctcccgcctcagattcaaacacagttttatctcacactgcaagctccctggcatgggcaaagtcctcgatgcctttcctggtggtttccaacatcaaggacatacttgttcctcctcctagctctctccctcagccaagtccttccttacaatgaattgtcctgcagaactccctcttaagcttggcttctgggacagaaaacctactttctgaaagggtatggggactgtcagagcatgaactggactcaagctcccaattacagagcagacacaaggctctgcctgcaccaggccatccctggatttctgcagctccaggactctcttccagcatctagatgcagctactctcattccagctttgtgtcctgtttgatgcaaaatctttattccttcctgtttcaatccctgttgcatattctgtgtgacaaagcaagaagctggaaatcgagttctgagctttatacccagctctgccacaaatgtgccatgaccttgaataagtcacatgacttatctggacctggattctctcatctgtaaaagaggaagctgagctatactacttttaaaatgtctccagctttaattttattagaatatcagctgcttcctcctctggtttctcatggcaggttgtgcattcttctctggagacaccaaatttcattggagtatctctccttacaaatgtatttccccactagattggcccctcaagaacaaggattgtattttagttacctctgttatctctgtacctggggaggagtgagaaaaggagagcaggaaaggcaatggtatagtaccaacatttgttgagcttctattatgaggaattgtctatgctacacattgtacataaagtatgtatgattcacagtataaacattataatctggaatcaacctaaatgttcattagcagatgaatggataaagaaaatgtggtatatagacgcaacacaatactatacagccat

SEQ ID NO: 1253 - DNA, 632 bp, Homo sapiens
tacagaactctaatacaccagtacaatggaaagattcctaaattcaaaagccagaaggctgggttcctgttcccaccctgccttttaccttctgtgtgttcctgatgaagacacttcatgctccactatttacttacctctgaaacgaagggctgacccagatcagttgttctctgacctgcttggagggactcagaggctgtggagcaacagatttgggaatgaggaatcgttccctggaagagtcagagcgctcgtagacacattctgctggattgcacgagctcctcccctgggaaatccactaagactagaggaaagaattgcttggaggattcagaggctgaagagtggacagacggctttaattgagaaaaagaagcagaaaattgaggaagatgtgaggcatcaatgccagcagacgacatgtgacaggtgctagccacatggatcacactaaatttctgtcatttatatagataaaaaagaatttccaaagagctcctccataattcagcattaaccagctttaaatcatcacctttctttaccttttcaaagcacttttatctagctagctttcactttcagagtggccaattcaggtgaggattctcaatcctgttctgcag

SEQ ID NO: 1254 - DNA, 3826 bp, Homo sapiens
ccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttggattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgtgaagtcaggataaatttatcgaatgtccgttttccacatgcaactgtgttacagaagtagtaaaattggaagaatcatgtttatggtgttaccactgatggaaacacacaaacaccaagctaataataaatatataacttaaaaagctaattatatgcactgaaatggtgggaattttagtgatgcagtaattgaggagtctggagttttgtatttggaccaagaattatgagatgaggatctttttctgagtgttctaaagggcttcttgagggggagtggtttaaagcacttcatgaatgatgtgaagaaggtaccttgggctgagacagcattctaggtacagatggcactctgttcaaccaactgtggatggaaaatattctgaaaaaaaatacaataaaaattttaaaaatacaatataaca

SEQ ID NO: 1255 - DNA, 2168 bp, Homo sapiens
ggtgtggaaaaagtatgtcggcaagtcagctggtttcccagtgcaggacgcgctgacagctcgagtgagcggactgcccaggacttcggaactagacgagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaa

SEQ ID NO: 1256 - DNA, 2776 bp, Homo sapiens
aggttgggcctcaggcggtggaccagaaggagcttactcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggtccagggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaacccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagttcagcaaaatagagaactgcagtttcactccatcatctttttcagtggagttaccttctaacagacatatttcaaaactaaatttcacatctggaatagcacctactcctcagaaacttgcatatgaaaaaaagcagaatgaccagcgcagtactgttaactgttctgattccttgctttccaaattaaataaaagtcaagatgttttcagtccatcacataaaactacacgatttgggacattatttgaaagattaaacagtctaggaaataggaatttacttactaaaagccctgctgtaattatggatgaagattgtagaagcacggatgaaataagacagtcagactacattactgaaaaacactcaatacagcatatttgggggaaaaatggaaaggaagtttcaaattttcttgaagatgtgaaccagtctactcctaaccttctatcagagaattgtgactcttttgttagtcaaaatatgatcaatgtattaaacatagatgagcaaaggataaagaaaacatttaacaagtgtgattatgatagtatgggagatacttgtgtagtcactagttctgataaaaaccatgtcactgacagatgcattagaaacatttttacagttccagagttgacttttagtaattcgactttgaataaaacaagttatccagaaaaatgtcagccaaacaagaagtatcagagagagtataacaaaaatgaaagaaatgatcttagtacatcttttgagaacgattactacccaagcagctctgaaagaaaagaaaaatttgaaaatgattaccaagagaagacaccacagaaaagtattcagaaatatccagcaaactctatgggaaatataccttcggaagaattgcactctaagcagtcatgggactttggacttgatgagattctgatggaagaaggaggaatatattctttaaaaagcaagcgaatatctactaagaaaatctctcttgattctgcacagagtagtcggtctactagttactctccaagaccaacagacagctgtttcagttctagttcagatttgccatctgaagatgaagatcaaatatcacagcaaattgaagattcaaataggatgaccatcaaaaccaaggaaaaaatgaataatttttatgtagaaaggatggcaaaactttcaggtgacaggattgttaaaaacgatgacaaaattcacaaacagaatgagaatttctaccagttctcagtgaaaaataatacagatcagtttccacagttgcagtgcaattcagcccacattttgcaaaacaaaaccaatgataactgcgttctgcaggctgcaaggtgtgatgcagggatacaaacagagagtgaatctgtaatggaggaaaaattagatgttgccatacagtgtgatctaatttcaaaatgtacatgtagaagtgatgtttctctttgcaaccttgaaaggtgcagtggaaatattaaggcagataccactggagggcaggaaatccataagaacaactaatattctaaaatctctacctaggatgtagaatttcacttgcccttagaaaacaacagtaaatgttgaaaatttcattaacatgataagaaatgagaaaaagtagctaagcataagctgacagtgttcagggtgtatattcacggttcatgttaaaacattttaatattattaatgtatgtatttaatttgtatatagccatttccttaatagctttggtatatggtagagtttttagaaaataatatatttgtaaatgtactagcgtttttatgtgattattcagtatattacaatgatgcgctgttatttatgggttaaaatatgcttaattgcttccttccttgtagcatttattttaatattctttgcagttgcattttctggcaaaaatgttccctttcaagatatttaagatagaaaataatacctaatatattttatgtcctcattataataattttgttagctacttctctttaatattacagtcctatttaaaaattctagcattaatttgtagataacacatatcttctatttgcataacatagtttttttgttggtgctattaattcaaaggaaaatgttctgtaggattaaaagatgttttaatgtttttataaaataattgtttgaaattaaaaaatgatttatgttactaa

SEQ ID NO: 1257 - DNA, 1583 bp, Homo sapiens
agaggctgttgggaggttgggcctcaggcggtggaccagaaggagcttactcgggccctgacgttgtcaggaggccctgggggatcctgctgaagctgcgatttggcgcagagctgagatgtctgagctctagacacagggacctcagtgtcaaaagatttgggaagatgaattgggtcggggggtcccggtccagggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaacccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagttcagcaaaatagagaactgcagtttcactccatcatctttttcagtggagttaccttctaacagacatatttcaaaactaaatttcacatctggaatagcacctactcctcagaaacttgcatatgaaaaaaagcagaatgaccagcgcagtactgttaactgttctgattccttgctttccaaattaaataaaagtcaagatgttttcagtccatcacataaaactacacgatttgggacattatttgaaagattaaacagtctaggaaataggaatttacttactaaaagccctgctgtaattatggatgaagattgtagaagcacggatgaaataagacagtcagactacattactgaaaaacactcaatacagcatatttgggggaaaaatggaaaggaagtttcaaattttcttgaagatgtgaaccagtctactcctaaccttctatcagagaattgtgactcttttgttagtcaaaatatgatcaatgtattaaacatagatgagcaaaggataaagaaaacatttaacaagtgtgattatgatagtatgggagatacttgtgtagtcactagttctgataaaaaccatgtcactgacagatgcattagaaacatttttacagttccagagttgacttttagtaattcgactttgaataaaacaagttatccagaaaaatgtcagccaaacaagaagtatcagagagagtataacaaaaatgaaagaaatgatcttagtacatcttttgagaacgattactacccaagcagctctgaaagaaaagaaaaatttgaaaatgattaccaagagaagacaccacagaaaagtattcagaaatatccagcaaactctatctggtgtacaaaatgttctgagtttaaggtgatttttacactcatccattatgtgttgatgttaaatttattccttaaaagtttgagaactgccttccaggcttttctgaataatgacctgcaattataa

SEQ ID NO: 1258 - DNA, 412 bp, Homo sapiens
agagtgctccagctcccgcggaggaggctgcgggcggcgccccgggatagggaccctgcagctccagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccaggaagtcaccatggacaggccacacagaaattacagggagctatggttcttcaccttgaagagtga

SEQ ID NO: 1259 - DNA, 1462 bp, Homo sapiens
agcagagtgctccagctcccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaaaaattctggttctgccgccagaccttccactgccatcggcctctgcaggaggagccagacgcccggcgctctgcagagcaccggcccgagtaacacagagctcgagccggaggagaggatggcagtcccagcaggcgctcaggcacaccccgacgacatccaaagcagactcctgggcgcgtccggaaatcccgtcggaaaaggcgcggttgccatggcgccggagatgctccccaagcatcctcataccccgcgggacaggaggcctcaggcggacacctccctccatggcaatctggcaggagcgccccttcctctgctggccggtgcttccacccatttcccctccaagaggttaataaaggtttgctcctcagcacccccccgcccaacccggcgtttccatacggtttgttcacaggccctttctaggccggtggtgaatgctcacttacattgaccgctgcgagggaattgttcggcgagtgctgcccatcttcaaatcaatgcctgctcagaacaacagaaagggcctcagatgtactggtttccacagaaccattgttaggcttttgtgaagcatttttgaacctaataaataatgtcaaaagtc

SEQ ID NO: 1260 - DNA, 1336 bp, Homo sapiens
agagtgctccagctcccgcggaggaggctgcgggcggcgccccgggatagggaccctgcagctccagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaaaaattctggttctgccgccagaccttccactgccatcggcctctgcaggaggagccagacgcccggcgctctgcagagcaccggcccgagtaacacagagctcgagccggaggagaggatggcagtcccagcaggcgctcaggcacaccccgacgacatccaaagcagactcctgggcgcgtccggaaatcccgtcggaaaaggcgcggttgccatggcgccggagatgctccccaagcatcctcataccccgcgggacaggaggcctcaggcggacacctccctccatggcaatctggcaggagcgccccttcctctgctggccggtgcttccacccatttcccctccaagaggttaataaaggtttgctcctcagcacccccccgcccaacccggcgtttccatacggtttgttcacaggccctttctaggccggtggtgaatgctcacttacattgaccgctgcgagggaattgttcggcgagtgctgcccatcttcaaatcaatgcctgctcagaacaacagaaagggcctcagatgtactggtttccacagaaccattgttaggcttttgtgaagcatttttgaacctaataaataatgtcaaaagtccctagcgcagcc

SEQ ID NO: 1261 - DNA, 831 bp, Homo sapiens
ccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaa

SEQ ID NO: 1262 - DNA, 1131 bp, Homo sapiens
tttttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtcccttattggaccaggtacagacatttctcccacagatggcacgggcaaatgaaaagctaagaaaagaaatggcagctgcaccacctggtcgtttcaatattgaaaacattgatgggcctcatagtaaagttatacaaatggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatagtcaaataaattatctgaaaagaaacaggtgacatatgtctgcaaattctgtgaaaaagaatgtgattcacgggttcttttgcttttcaggcacctatggtgcttttatatgttaaaaactttagacaagttaaatttgacagagtttctttgggcaaagaatgattaatgagttaggtagcattgtaaactgaaaggggttcagagacctccgctctacagcaaggaaagtgtgcttttatcagctgaacacagaagtagagtacaggaataacttgatgggttacagctaggtgtttgcctaaataaggcaaagaggagacctaaggctgcctgatgtcccataggtatggtctgatctaaggagatctaaggctgccttgtccgatgggctgaggcttggctgtttgtgattggccagacttggctatttgttataaaaatacactcctgagttaggttttggtgtgtagagtacaggaataacttgatgggttacagctaggtgtttgcctaaataaggcaaagagg

SEQ ID NO: 1263 - DNA, 1718 bp, Homo sapiens
aggaaaattctagaagtttgagtttgtgtgcttactagcaaccactttcagcgtttctgcaaagctagagaagggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaataaaggagatgtgttataaatctggggaatactacagatttcatactcctccagatattttgtcatcaaaaagcatgacacctacagcagaaaaacagttagaaaagcctttggaaaatggcagtgaattgcaagaaggagatagtcttacagttccgacaaaacttagccaatatgaaaggcaaggtgaaataaaaacatcattgcatgggaaaccaaagactgacattgctgcttttgaaaatggaggaggtgactgttatgttccacagagggtcatatttcttggagtcgatgaaagtgaagctttaactgaagagaaagaaatcaccatatcaaaatgttcaaatactaaagataacaaggacagtcctcatccaaagcattccctaactacccgactagtacctacaacgcatgtattaaatgctactgagaatatcagtatgaagtgcagagaggacccctcttcaatgaatgatgtccagccagtgaagaagcctcattttaaaggtgtgaagaaaagaaaatggatttatgatgaaccacagaactttcctaactctggaatgcagagagcagtacaggccccaagaccccaaaataaaatgagttatcaccgcaataataaaaatcgaaatgcggagaatgcatcctatatccacgttcaaagagatgctgtcaggactgtcgcgttgaatgcaccttcccgcagcaggcccacgcatgggtcctacaataaagtccatgctaacagggaacccaaacccaacctcagtccagacaaatatacgtcaacatcatataatgattcagcctggcgaaaacgaattcctttttcaaaaacatattcaaaaagtgaaaagatatatccagagccaagaagaaatgggagcaagtaaacctggaggttgagagagagaaaaatgagaaaaaattgccagacatcatctgatttacaatcaaaaatgaaaattcaaagaatgagatactcaagtactccatgttatgtagtggatagccaaagatgataaaaatgcaaattctgaaaataagatgcaggaagtacattgtgctctttcaaaactgataaaaatgcaaattaccaacagctgccagtgtatttatgtaggtctggaattcattccgtgcattactccaaacattttaataaaatttaaaagtttgacaatt

SEQ ID NO: 1264 - DNA, 599 bp, Homo sapiens
agtttattgacttgaaaacccctgcctactaacccgtgctatgagagtatatggatctactttaacaagggggagagagtgaagatggaagtaggagagagataaaagataaagaacaaccatggaacatgtgtcaaaagagggaagaatgttatccacctctcttcccacacaacaggggcttgtagtttttaccaaatggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatggt

SEQ ID NO: 1265 - DNA, 887 bp, Homo sapiens
gagatggggctcaaataggaaaaagtctaggggtgaaggagtggggcaaagtgtaatttggggaaccaagcaggggcctggagctatctccatcttcagctccagagtccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaagacttgccttcctggttcttcctgggctgtggaatgggtagtgatagaatttccaagtatgatagtgcatttggttcaaagaacagcactgtagcatgggagaacctgcactataatgtcataaactc

SEQ ID NO: 1266 - DNA, 687 bp, Homo sapiens
ggcctggagctatctccatcttcagctccagagtccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaaga

SEQ ID NO: 1267 - DNA, 1712 bp, Homo sapiens
cgcgcctggagaggaggcgacgcgtggccggcggctttgtggcgcgcgggttccagcgcgggggcggggagagggcgagctgagggcctcgagtcccagcactccgccacgctgcgggcgccgggcatggccagccccttgccgtccggcttccccgcgcgcaggaacagccgcctggatgtgttcctgcggcggcatctgccgcccgaggtctacgacgcggtccgcgcctacgagccatgcatcgtggtgtccaactctgagaaccacatcctcaagtatgtggtgctaagcgaccggctcgtctacctaaccgagaacccgcccaagtccatccggcgggtagtggctctgcgggacgtcgtggccattgacctgattgatgattacccggaatttttgagttcgccagatagagaaatcagccaacacattcgtatcatctattcttcaaccgttttgaaaaaagagtgtaaaaagtcaaacagtgtcaggaaattcctatttccatttcatcatactaaagctaacaacaagaaagtcaaggaagaaaagaacggccttgccttttggagaagcaaagagtccagaagtctgaaagaatctcctctcaggtctgaggagaaaattaagcacttcagtcaacttaaatctgaactttttcttaaagacaattctttgaggaggatactttctttacttatggaacttaaagtagcagcccagaaaaacttcattctgaaaaggcttttctggaagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctggtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgatttatta

SEQ ID NO: 1268 - DNA, 2074 bp, Homo sapiens
atggccagccccttgccgtccggcttccccgcgcgcaggaacagccgcctggatgtgttcctgcggcggcatctgccgcccgaggtctacgacgcggtccgcgcctacgagccatgcatcgtggtgtccaactctgagaaccacatcctcaagtatgtggtgctaagcgaccggctcgtctacctaaccgagaacccgcccaagtccatccggcgggtagtggctctgcgggacgtcgtggccattgacctgattgatgattacccggaatttttgagttcgccagatagagaaatcagccaacacattcgtatcatctattcttcaaccgttttgaaaaaagagtgtaaaaagtcaaacagtgtcaggaaattcctatttccatttcatcatactaaagctaacaacaagaaagtcaaggaagaaaagaacggccttgccttttggagaagcaaagagtccagaagtctgaaagaatctattctacctgacagggaccagcaggagagcagtacaccatccaaggactcaactctctgtcctcgtccaggcctcaaaaagctgtcccttcatggccaaggtgcctttcgacccctaccttccccctccaggaggagctctcagtctgcaccaacaactggcaaggctgtcagcgagccatcttgcacaacaaacacaaaagaaccccagggacttccagatcacaactccataagtgaaattcctttcaagtgcaatgggaatggaaatgagttttacttaggaaattccctcttagattccccttcacagagcaactcaaatttagagaaaaaggagtcagaacttcatttgtatgttatttccacaacctcatcaatatttctgcacttaaaaagttcatggaacaattatattatagtaaaagctactcttttacaagatcccttctatgctagtgagttcagtcctgctattggaagtcaaaagccatataggtctgaggagaaaattaagcacttcagtcaacttaaatctgaactttttcttaaagacaattctttgaggaggatactttctttacttatggaacttaaagtagcagcccagaaaaacttcattctgaaaaggcttttctggaagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctggtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgatttatt

SEQ ID NO: 1269 - DNA, 560 bp, Homo sapiens
ctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 1270 - DNA, 1684 bp, Homo sapiens
tccaggaccagagtctcttccggttccatacaatactcaattggttggttgtcggctaagagcccgcctcattgcgctcatctagtacaataggaattagaagaagatagctgctaactgagtggctgacggtcctgtctctcgagttggaggcatcttgacttagttgctgggagcctgtgttggaacttatttgttggagaaatgtcttcagagtcagaaaaggataaagagagactgattcaagctgccaaaatgttcttctttcatgtacaagatcttgcttctgtcataaacacactgactgaattgtttagccgcagtatgaatactcaaatccttttgatggctgtgaaaaacaatagttacattaaggatttttttgagcaaatgctcaaaatttttaaggagatgcaatctgtagtggatgcaagacatgacaaaattcaaaaggagtctttatgttccaaggttgcaatggccatgtgctctgtggttcagaagagtaccaatgtagaggagttgcatcagtcagctaaagaagtattcaaaagtgcccatacgccagtcatcatctctgtgctaaacagcagtaacatccttgggagtctggaatcttctctttcacacttgatgaaattccccatcatgaatcttcaattaagtgacttctatacagaagacaccaaagagcaatcagatgtcaccacatctgagagaaccagaagtcctccaggttcttccaaaaccactatgatagacaccttgaaaaaactgcaggatgtactaaaaactgaggattccaaaaatcccacaaagtcagcagcagatttgttggaacaaattgtcaaggctatgggaccaatcttagagatcctccaaaaagcgataaagactatggaaatgaatatttctgtgtttaagaaagccagtgacaagtagggatgcaacagaaatgttcatttctgtcagaaaactacttaaaatcttatggtttttcatagtagtttctaagatcttttggtgccaaacatgtgctatgttagaacataagtacacaaaagtcatctggcaaaacatttacctgtagttttgctttattaaaataaaaagaaataattaagaaagcctgtttgaaatgtcagtcactaagaagaatatattgttgaaaaaaacaaagtggtattacatttgaggatgtttctaaatattgtgtttcatcttaaagcataattaaaacaaccctaaagtagttcccactcttaactattctatttccagtgagaaatccaggtaaactgtaaatattatcattagatagaaaatctaggcctgggaaacaaaataaactccatttttgtcactcatataccaatttctatatacttcagtaccttgacgatcagaagccatcactaaatattttaaatatgattcataagtaagtgagaacagtgaatgagcaataatagacttttcttgcttatgtgagtaagaccagaacagatagttcattctcacttgtctcctgaggtcttatgattagaaaatactagaggtggaaaaatggaagtactctagcctttcacaaagaaaagactttcacaaggaaaacacttgcagaagtaggatatctgagatgtgctttatttaaagaaatgagatagggcagtctctttgtcta

SEQ ID NO: 1271 - DNA, 1684 bp, Homo sapiens
gctctgaagagagaaaagcggcggtgtcctgcggagagagccgctccctccactgcccgaggggagcgcgtcgcctcagccgctcgaaagcaggaaatgggcggcaaaagcgcagtcagacaccaactggttctggactgcccccgagaggcagcgagcagcgctcccgcgcttcgcccgctaggagctgccgccacgtcccgagctgcgccgctcgcgcccctccctgctccgagtccccggtgggggctgggctgcggccgagtccggtacccgggcccccacccgcgccgcgctgtcgaacccgccgccggcccgctctcggcgccgataatcgccggcgggcatcccgcagaggctgccgccggctccgccaaacagcagccaaggcatagccgggaagtccccaggccacccgttccccagcacccttcggggaattcccgttcagctctacaggaggcgaaaacggaacaaacgaaaaccccttaacagtgaaaccgggcccggcgatggcccgggtggcgactgcgacgactcgacgcgtgcggacacaagacccgtctcgcgctccgctgctcctgtgcgtccggacgaaccttagagatcacttaaggaggctcgcgcgctactcctcaccacgtgaccgccccgccaggccgccccccgcgccgccatcttacatccgggacagaggcggcgtcccctttccctgccttggcaggcgtcagcgtgctaccagaaatcagccctgaaagaggggaccccgattccacgtcaccagagtgctgaggcagcgggcgatgccctccatcggctcagcgggggggagtggagtcccaaacttttttcggcctttgcccgcaaagaagatggcggcgcatatcgccgcctaagcggacacgttgtaccctggccgtggtttgaagtttccggcacctcctttcccaaccagcaaggacacaaccatacgagccccacccacgcggggtggctgccgtgctacattccgcagaaaacaggcgggaaagctgcggcacagcccgctttaaacgcaagcttttgggacttctggttttggctttttctttttaagccaagttagggagaaggctgactgccatggagccacttctgcttttggcccagacaacttacgggattttttttttcctcccatttagagattttttgtaggaagttaacaaattattttaaagaagtagttagggcttgtcagataaaatacaggacgcccagttaaattggaatttcagataaccagtgttttggcatatgtgtgttacatatatttttaaaattgtttatctgatattccaatttaactgcacattctcaatttttaatgactgtatctggcaaccctatcagcctttacccctgaaaatccagactgcttatgacaaaagtaaggaatggagggaaatgaaaagcatgtttacctacaacttagaattgtctttgcccagactttgatccttcatggaggccagagggccgtggtctagaacaaaatttggcagcaactcataaagatatccttgtataattccctttctggcaaagtaagattttttttttcttaagctatcacgatgtaattttggacaacagatcctcttggccaagagtttaattgcaaattaaaaattaaataactggc

SEQ ID NO: 1272 - DNA, 2418 bp, Homo sapiens
aatatggcggcgcagggctccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttgtgccacttctttgtttaatatctggactaaatacgcccccaggctgccagcagactattacaacgaaaagcttctgaaggttggagatagcctttgtcaaatgaaagaatacaaactggcccttttacaatgctatggaagatatcttcagcagttcaataccaattttgatgagaataaagtggatgtaactcaattcaaagctacctttttcccaaaaggctttaaagataaaactgctggacttacatttcatgctttgagtggcaaaaatatgtgcaactaccagctggtctgcgacagtgatgaaaacctgaagaataaagaatctgtggtccagtgtctgcatatcttgtcctccttaaggctcatcatgcaagtggctctgccacaagagcatctttgctggattatcttcaatggtaccatttatatttacaccatttgcagaaaactgatggtcataggtcagtcttccaaggccttagagtatctcctgtgggccagcatgtgtatggagtccttggtcccgctcctgtcactcaggtacttgacatggcgcgctactctctacacagctgtttgccagtgctgctatgactgccatgccgggattcacggagaggcatttgctcggcgtgctttggctaaaattgatgagttaaggcaactggaattaatgagttcctcaaaatcccaggaagaatcgcgaagatattttcgagaggccacaatgaagatggcagtgatgatcttcaaaagaggagtctttgaatctagaagaaaaaacaaagctgtctttagacctaagataagaattaacctaagggaagtacaaactttatcatggccacgaactgtcacagagcggctactggatgagatgtttgatagcactgcatcccagtttctggctgtcttggaagctctttctgattcaaataggcgaatactgcaaactggacccattgttacagatgaagtggagattcatgatgttgtctcagaattgtttatggcaggaaaagaacttttgataatgtcaaatattggtgcagatggaatgcttgattttccaaaaacatctcttctggaacttatgataggaagaaaagatgttatttctgtggatgctgctgtgaaatttataaaattagcttttacctatgaggagtggagtttatttgaatcttctgctgtacatcttatttattttctccagaggcaggatgatccagagtcaaagaaagcagagaaggatttaactcttctgattgcaatggaaccactaatcaacgtgaagagaaacaaaggtttgatctttcctttggaaaactataaagaaggacagtcaactcaaatttatttaaaaaaaattgctgttcatgatacttgtttgaagacttgtggatattcagaggatattttccatttggcagcaaccttgtatgtctgtgtctgcactgctccccaggatgttcaacctgataaagaaattgttgtggacacgataatgttcctatggcagaaatgcaaattaggaattcagcggctcaatatatccagaaatgactatgcaaaattcacccagaaaatcagtactaacaaatggatttatcttctgtggcagataaatgaagtaattcactgctataaaatggaagacattgacattgtggtagtggcagaagtcacattacggttaagtgaaatattggaatctttaggaagcccaggaagaaaatttaaacaatctctagatgtacctttaagagaagggactaacaaattccctggagctccaaaagggatcacagaaattcttccaatattacagaaaaatcctgtggaacagttactttttgcttataaacttcttgacagagcaatcggtggaataaatttgaattgcatgttaacctctttgccaaatggatcatcagtaattgaccactgctatgccaagcgtacccaccatatagatggagatacttacaaaccacttgcctcaaatagtttcatgatggatttgcatcttgaactaattcaagctcagcatcgaatagctgttgtgcttctggacaaattgcaaggtagt

SEQ ID NO: 1273 - DNA, 3686 bp, Homo sapiens
ttccttcttacagccaaaaaaagaaaggccaacttaccatcagatgctgaagaattttctacatttattaattccataatgagtgatgaaaatatgtccaagacacaaacagtttatgactcagactctcaatcaggttctagtgctaaagaaaaggaccgaggagcaaatttgtgtgtaatggatcattttatgaaaatctttttatactgcaggagagcaatggttcttgctcatcgtggtggctattggactctgcttcagaactgctgtcgggccttatggaactttactcaggaactacaaatacttcttaaacaggcagtggatcttgataaaacatttcctattagccaagatggtttcctctgcacctctgttttaccattctatttgggagcagaattacttattgacatgttaatacaactacaaaataccagttctattaagcctattgaagacaaaggagaattcagtgttccaagctgttatgggaatattaaaaatgacaacggtggttctagtcttacctttgagcatcctttggatgatgtaaatgtggttgatttgaaatggatccacgactttgtattaaaatctctggaagttttatatcaagtggaaaaatgggaaacactagtatctcttgccattcagttcaatacagtttcacatgagaggtatacagaacaagtgacaccacttctggtgtatgcacagcgccagcttctgctgagaatacagaagttcaagggcccagatattacccaacaaccttgtgcaaggtatgaggctgaatatggagagaagataacttgccgaaatttcattgggaagcagcttaagattaattcttcaaccattgaagcaacaagcaactgcacagatttgctaaaaatgcttatctcttcagaatacagccgagccaaagcgcttgtctgcgtgcccgtggacgtgacagacaccttgaggtgttttagagagacactggaaaaatccaaataccataacagatcaatccgacacagcagaaagttgctttcattatttcttgcacagacacaagatgttctccaagccagcaatcaaagaagtcttaaagttcaggcgttgcattcacttggaagtcttctcatcttcgcagaaaagaaaagggctgcttttaagtgttggtgtcaagctcttgatgacatattcagaaaaccagacgtgctacacacgtggaaagaatttggcccctcactcaccaatgtcaccaacagtcattcacctccgggtttcaaagactacagtgaggagtttctgtcaagagttggcatctgggggtgtttgcaaggagcagtcatatcagcaaagatagcacaatttattaagtcattgaatgttgaaaagaaaactgactgttgcattttgtctgcgttactctttcagggtttgcttagaacaacacttccacatcccaaagctgaacgttgctatgctcaatatgaaatcactcagcttctcccaggcattgaactcttctcagatagatacagggctgacatttgctctgtaattgcaagtctgtattacattatacgtgaactgcactttgttaggcaaaacctaatagttctgcctctccttgcattgtatcaatattttgtttctggaatttgtcaagacataacaagaaatctagaagcaagaatcctcaagatagaagtccttatagatttgagattcttttctgaagccttttatgagatatcccaaattttctatggaaaaaacatgccttgtccaatacctgcaggctataaagccactggaaaaatgaagatctttcaatcatttgactcaggaaaacttcttaccagtaaagaaaatatacaggcaattgatgaattaagaaataaaggcttgcctgcagttctggttacaattggccaaccacatctcttaaataagtttaattttgttaaagcatactttttcctaagtgtggctgcgacaataaattgtgtcccagaaaataaatttaagacagtaattaccaacaagagcaaaccaaacctaccaaacttggaagagatatattcaaaggatgatggaagttcattttataatcttacaaaacttaaagatgagatcactcttagcatgctaaagtcgatgttactgatggaagctgaggacaggctaaacttccttctgtccgaggtggaacagaagaccctgtctcagtgctccgctggcgagctggagattgtggtggaggcccggcttcagctggctgcagttgctctgcagaggcaccgggcggcatacagtgctgcaatagtattttctacacttacacttctccaggattcaaaactttttgaaaagaaggtagtacaggatgacacagagaatcctgtctctccaggaacttctgtcactgaaaataaagatgacagtgagtttttagatcctatttccctaaatgcccgagaatatttcaacattcatctgtggttgaggtgccgcttagcattggtgactgcatttgttgcacagattcatggcattggaattgtgaaagaggatgatatgacagattgcctgagcctcatcaatgaagtgtgtatggaggcaaaaagcgcaggggacacggaactgcaggctgaattcttgacgcaagctgtaattcttggcctacaagaaaagcatttaaaggcagacatcatgacaaaccttcaggatataatacatttgctggaaggaaatgaatttatttctcctcaatcacggctaaccctggcaagaagcctagttttgctggatgacttaaccaaagctgagaaattcaaggaatctccctcttcaaaaacaggaaaattaaatttgttaactcgggctcatagcattctaactgaacagatgctagcttttggagaaacaattgaatttcgttcatcaaacactaaatatgcaaatccattacagcctttgaaaaatatctatcttccccatgtcatgttattggccaaaataaaaatgagaattggacatacagtggccaagcaagtatattacaagaataaaaggaaggacccctcgaagtggttacctgctcttcatctgtttgatgtggcactgaagctctgtagaacaacagcagtggaggaacatgaggtggaagctgaaatcctttttcagaaaggcaaaatagaacgtcaaatactaatggaagagaaatctccaagttttcaacttgagagtttatatgaagctatacaactaagcctgaaaaatgatcaaaactcaggattgataagagactcctacctagaaatggctctattgtattttcatctgaagaagccaaagataaaaatttcaggatcaccattaacacttaagcctcctctcagaagaagtagttctgttaaagaaacatcagcaaataaatttgaaatgtacagttcattagcctggattgcaataagagctgctgcacaggtcagtgaagctgtgctggcaattaacttacttattggaaagaagaatactagaatgcataaagttaaccaagtggcattaccaaatatcccagaatttgctgctctggatcttttgtcttcgtatacagattatttgcttggtatgtttggatgtctacatattatgcaaaaaaactgatatatgtaatatag

SEQ ID NO: 1274 - DNA, 2593 bp, Homo sapiens
ccggaagtgcgaggccgaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatggcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggagccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggcttttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagt

SEQ ID NO: 1275 - DNA, 1272 bp, Homo sapiens
acctgccttggtgtttaccactcaaatggttcctctctgcctttggtgctgaggaaaggaggctctggcaccactggaacaggaaaacttgactgttgctagtctattccattgaacttacagatatttgggattaccaaattgggaagagcaaagctatctccagtgccgaagaaatggctctcacgcccacaaacctaaataacaaaatgtctctgcagatgaagatggactgccaggaacaacagctgactaagaaaaacaatggctttttccaaaagctcaatgtgactgaaggtgcaatgcaggatttgctaaaggaaattatcaaagtggaccacatcttagacagatcggatgatgaggatgacatttcctccgaaaaccctcaaactgacttccttcacaagggtatgttggagctagaggctgagcatgaccaggacctgagtaaacaggataagcaagaaacagatgttgatgaggaccctcaagcgtctacatctctgcagttttcaaagaagaacctccttgaactgtgtctgaagggcatgttcctcaagctaaactactggaacacaaagataggtctccaggtgaaagaacttggagctgattacatagacggaacggagaaaattgacaatattattaaaaaaataaatgtaacagaaaacacagtgaagagcttattaaaagacatgctgaccctgaagggtcaaattgaaaagctggaggaccggggccttgaccttgatcaagggacaagcactgaggtgaatacttgtaatgaagtttatgaattaaagaagaaagtcatagaaaggctggaggacctttgcaagaatgtggaactgctgagtgcaaagctaaggatgtatcaaatggaggcagaggacactgactctcacagttctgaggaaatagatacggaagagatggaggccctgcttcctcaggccccagcatcctttttagtgcagaagtctcctccccgcaatacagcatggaaacgtgcactgaggattttcatcatgtttgatgtcctcaccgtcactggacttttatgttacatactattttttggtgctacatttctctttgaaagggtgcttctgagaatgcttgggtgccgcaccacatgggacctacgggagatgagagagcctttcttgaatttggaagtggaagccttgttaccctcctaaagatacagaagttactgtcaccctactgactttctcaccagtaaacattgtggctgttcctgta

SEQ ID NO: 1276 - DNA, 1096 bp, Homo sapiens
atggctctcacgcccacaaacctaaataacaaaatgtctctgcagatgaagatggactgccaggaacaacagctgactaagaaaaacaatggctttttccaaaagctcaatgtgactgaaggtgcaatgcaggatttgctaaaggaaattatcaaagtggaccacatcttagacagatcggatgatgaggatgacatttcctccgaaaaccctcaaactgacttccttcacaagggtatgttggagctagaggctgagcatgaccaggacctgagtaaacaggataagcaagaaacagatgttgatgaggaccctcaagcgtctacatctctgcagttttcaaagaagaacctccttgaactgtgtctgaagggcatgttcctcaagctaaactactggaacacaaagataggtctccaggtgaaagaacttggagctgattacatagacggaacggagaaaattgacaatattattaaaaaaataaatgtaacagaaaacacagtgaagagcttattaaaagacatgctgaccctgaagggtcaaattgaaaagctggaggaccggggccttgaccttgatcaagggacaagcactgaggtgaatacttgtaatgaagtttatgaattaaagaagaaagtcatagaaaggctggaggacctttgcaagaatgtggaactgctgagtgcaaagctaaggatgtatcaaatggaggcagaggacactgactctcacagttctgaggaaatagatacggaagagatggaggccctgcttcctcaggccccagcatcctttttagtgcagaagtctcctccccgcaatacagcatggaaacgtgcactgaggattttcatcatgtttgatgtcctcaccgtcactggacttttatgttacatactattttttggtgctacatttctctttgaaagggtgcttctgagaatgcttgggtgccgcaccacatgggacctacgggagatgagagagcctttcttgaatttggaagtggaagccttgttaccctcctaaagatacagaagttactgtcaccctactgactttctcaccagtaaacattgtggctgttcctgta

SEQ ID NO: 1277 - DNA, 1023 bp, Homo sapiens
atggcatattcatcctctaacagcgacatagaggacgacagctccaaatccaattccaacctgagcctctctgtgggctatttcccctgtgaggacaccccctgtgaggacacaacctcctgggaagatgcaccttccaagggtccttccatccactttctgcctcccgtccaaggggcatgggggactgaaaggatagggagacgcatgaagagacaagaccaaattcaggatgaaccagagcagttttgcaaactaagcatcttcctggcctgggacgtggacattggctccgataacacagactcaagagctaataggcttctaaatggagacaacctgtggatagacaagttaccaaaagagagaacaaaactgtctgttggcaaactgaataatcttgtgcaagagtttcagatatttctagaaaatctgaaagatgatgacgctgtatttcctgaaactgctcagcaagatttccagctatccagcggctcccctccggaaatggttcaggtcagtcatcaggaatatgatgcttgtcaagacctgcccaagtgcaagccaccagaaaataaagatgttatgcttaagggacatgagctggctgagatgataagccaggcaaccgccagccaaaggacaagcgctccagagatctcctcaatcctgtcagagcagccagagaaggatgacactccttcacacacacaggcccagtgctgcctgaactttgggtgggccttcagctggctgaggcagcgtatcctcccctctctgctgaggagggatcaccctgtgaatgccaccaaaagtccccatcggtcagcaccaacgaaaagactctttcacagaggcaagagaattcaacctcaagaaacccttgaattaggacatcccatatagacagatttttaaactttttggaaagtttaaaataatccataataaggattccattaataatccccatcagtttgttttttcctcaataaacaaaataaatgctcttgttaccccaca

SEQ ID NO: 1278 - DNA, 957 bp, Homo sapiens
aagttgagagaaatttgtgcctttgaactccatggcatattcatcctctaacagcgacatagaggacgacagctccaaatccaattccaacctgagcctctctgtgggctatttcccctgtgaggacaccccctgtgaggacacaacctcctgggaagatgcaccttccaagggtccttccatccactttctgcctcccgtccaaggggcatgggggactgaaaggatagggagacgcatgaagagacaagaccaaattcaggatgaaccagagcagttttgcaaactaagcatcttcctggcctgggacgtggacattggctccgataacacagactcaagagctaataggcttctaaatggagacaacctgtggatagacaagttaccaaaagagagaacaaaactgtctgttggcaaactgaataatcttgtgcaagagtttcagatatttctagaaaatctgaaagatgatgacgctgtatttcctgaaactgctcagcaagatttccagctatccagcggctcccctccggaaatggttcagatgataagccaggcaaccgccagccaaaggacaagcgctccagagatctcctcaatcctgtcagagcagccagagaaggatgacactccttcacacacacaggcccagtgctgcctgaactttgggtgggccttcagctggctgaggcagcgtatcctcccctctctgctgaggagggatcaccctgtgaatgccaccaaaagtccccatcggtcagcaccaacgaaaagactctttcacagaggcaagagaattcaacctcaagaaacccttgaattaggacatcccatatagacagatttttaaactttttggaaagtttaaaataatccataataaggattccattaataatccccatcagtttgttttttcctcaataaacaaaataaatgctcttgttaccccac

SEQ ID NO: 1279 - DNA, 1856 bp, Homo sapiens
agccgttgtttacctgacttgttcttaggctgccttagattctgagctggcttccctttaggctttttcataaacaaataactggaaatgtctctaaggaggggagagaccagttcctcattgcagctggtagcaaggttgctttcactcagccaggaggacgcattgttacaggtgtggaacttgttgctccgagccctcgcctggcagctcactctggatctgcgggttctgaggagcctcgggacccacctgggtgcagttgccttcagggacagaccatcttacagatgcaataacctgcttgacattctcctctggaaaaggaaaagaactacgagaggaagcatggcacttggatgcagaaattgagcaccctccatgtgatccagagaacagcaactcatacgtcttctggaaccttctaccaacagtagaacctcttagctttatggagaaaacagagtcattctgtccagaggtgccaccccaagactgtggagcctctcctcggccctcgctgaggagcctgccaaagaaccaggggagtctcctccagtttgaccggcaagccccaggccgcatctccacctcgcccactttgaggagattaaggacccgtggctgtgggacaaggcaggatgcctggcaggtgaccacctggggaagctggggagctcctgtgggcttcccatgttacctttcgaagagcctgccaggaagcccaaaggattcttcacacttgctgtcacccttgagactccactcaagattgacctctgaacctgaaagggccctgaatgcagctgactcactggagccccaaacccggcccactgacaagtatctccctcctgagcttcagcctgtcaatgaagggtcccttcaccaggcctctcttcggcagcaagaaggccacttcctgcccagccccaccctacgacaccctagtcctcagggagaagaattgcacccatccaggtgtgtatgcatttattttctccggtgctatgacatctgttgactatttactattagatttttatttctgtcctgacataacaaagctgacggtgtgttaaccagtgcactttgttttatagcactcaagtcactcttcgcatttataggtgcacgagttttcatttcaagagtctccctttaagagcacagcatttgggggcaggatacaatgccatatgcagtcatagttttcattttgaattgtcaatgtcttggccctgtggcttaattaacatccacttagtaataggttttgtctggtagagaaaatagaaaggccagagatatgcaacagcttttcaaagaaaaatttggaggataaaagaaaggaacaagatgtcctggttaaatctagggtgacctttaaaataacctgttatgacagactgtgcccttatccagaatgaagtagactgtgtcatttccaaaaccagctctgaactttcagcacggccccctggttgtagcaatggatctgccatctctgacagggatgaagagtttctgcagcagcaagggaaagatccatgcccaattttatcttcctgacttgtgggattggcaggaaagccctcatttcatttgaaaagtcacagaggatttttttggagaaatagctgctgttttattactggacctcaatcctcaagcaatagtttgatattcatagcagtaaggataacatccatgtacacattctttgttgattttaatccttgttggcctaattgtaccaacaaaggtagaagatacttaccaagccatagggaaatgcaaattgttatgtctgtgtatcagctagctgttgctagataaaaaaccacttaaagtaa

SEQ ID NO: 1280 - DNA, 2184 bp, Homo sapiens
gttgctccgagccctcgcctggcagctcactctggatctgcgggttctgaggagcctcgggacccacctgggtgcagttgccttcagggacagaccatcttacagatgcaataacctgcttgacattctcctctggaaaaggaaaagaactacgagaggaagcatggcacttggatgcagaaattgagcaccctccatgtgatccagagaacagcaactcatacgtcttctggaaccttctaccaacagtagaacctcttagctttatggagaaaacagagtcattctgtccagaggtgccaccccaagactgtggagcctctcctcggccctcgctgaggagcctgccaaagaaccaggggagtctcctccagtttgaccggcaagccccaggccgcatctccacctcgcccactttgaggagattaaggacccgtggctgtgggacaaggcaggatgcctggcaggtgaccacctggggaagctggggagctcctgtgggcttcccatgttacctttcgaagagcctgccaggaagcccaaaggattcttcacacttgctgtcacccttgagactccactcaagattgacctctgaacctgaaagggccctgaatgcagctgactcactggagccccaaacccggcccactgacaagtatctccctcctgagcttcagcctgtcaatgaagggtcccttcaccaggcctctcttcggcagcaagaaggccacttcctgcccagccccaccctacgacaccctagtcctcaggtaacacagctctaagcctccggcctctcagttgctgaaccacaaagcaaaatagatctcagagttgcttagttcccccaagggccagtagatcctaaaaaggagacagcacaggaagtcacactgaggggacacattctctttaggaagcattggctcttaagtgaaaggagggcagcaatctggggaggaaagaaaatgatctcgctcactttcttctgtccttagaggcactttgagaaaggatgcaccaaggccaggcttaccgatggtctgtcaggtacccgagagcaatgggggccctcttgcaaatgcacactatttaaagacaacgtcgtgtcactgatttaaaaggggagaaagagccagttattcaaatttccaatcccaccaaaatgtaaaacatgttttaactaggagggctcattgtttctcctttcaacatgtttgctttggagtttgggatgggtttgagcaagactaaaacatatgttcttaaaatttatttcagggagaagaattgcacccatccaggtgtgtatgcatttattttctccggtgctatgacatctgttgactatttactattagatttttatttctgtcctgacataacaaagctgacggtgtgttaaccagtgcactttgttttatagcactcaagtcactcttcgcatttataggtgcacgagttttcatttcaagagtctccctttaagagcacagcatttgggggcaggatacaatgccatatgcagtcatagttttcattttgaattgtcaatgtcttggccctgtggcttaattaacatccacttagtaataggttttgtctggtagagaaaatagaaaggccagagatatgcaacagcttttcaaagaaaaatttggaggataaaagaaaggaacaagatgtcctggttaaatctagggtgacctttaaaataacctgttatgacagactgtgcccttatccagaatgaagtagactgtgtcatttccaaaaccagctctgaactttcagcacggccccctggttgtagcaatggatctgccatctctgacagggatgaagagtttctgcagcagcaagggaaagatccatgcccaattttatcttcctgacttgtgggattggcaggaaagccctcatttcatttgaaaagtcacagaggatttttttggagaaatagctgctgttttattactggacctcaatcctcaagcaatagtttgatattcatagcagtaaggataacatccatgtacacattctttgttgattttaatccttgttggcctaattgtaccaacaaaggtagaagatacttaccaagccatagggaaatgcaaattgttatgtctgtgtatcagctagctgttgctagataaaaaaccacttaaagtaaca

SEQ ID NO: 1281 - DNA, 1366 bp, Homo sapiens
gggtgggtccggcgggtccccgggcggggcggggccggggcgaggggtgccgggtggtttccgcccggcagcccgcagcccgctgcgccccgggccgcgtctcccggcggtgggagggggcggcccccactcggttcctggcccctcgcggccccgtcagcctcccgctcggggtgcgccgcccttcgtctgggtctccgcccccaggacccgcggccgagagctccggagcgcggcttccccggccggctgcgcgatgggctgcgggaactccaccgccaccagcgcgggcgcgggccaaggccctgcaggagcagccaaagatgtaacagaagaatccgtaacagaagatgacaagaggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacaatgtgtatttcattgcactatttaaaaataaactcaaatttgcatgccatatgcacattttgattacatttttattttctttcgtgaaaggcatgtgcaactacaaatacttcatagctgtttgggttgctcattctacatcacgacaatctcatcatattatttctataacttttcaaggacttgcgatggatggttagtgggatatctggaaattaatttgataatgacttgtgtatctacttagtattgcaatgtaagttactcaattcaccaatgtatttcaacaattaaaacatttttatccctcttca

SEQ ID NO: 1282 - DNA, 1946 bp, Homo sapiens
agggagaagatgactgagccggccgggtgcagtggctcacccctgtaatcccaatactttgagaggccgaggtgggtggatcacctgaggtctggagttcgagaagatgacggagcagtgtgagccctactgaaccacatccagtggattttccttaggaaggaagatcctgttaccagacaaaatgggaaaaggaagtgaggagggtgatgtgagagcttgagggggaggtcagaaggtcagagatgacccagttctggaggtgaccccatagaaggagaagaatccagccacgtgatacacgggaccaagagaacagtaaatgcaaagatctggaagcacaaaagaggaacagcaaggacagcatgttccagaacctgcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaagtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcct

SEQ ID NO: 1283 - DNA, 1516 bp, Homo sapiens
gttaaggtactaatcacagcagcagtgctgggaaagatgcctaggaaggatgaggatgacaggcactattttggtgtgctccccaccacagcaataacagaaagatagtccaggtgcagtgtctttcacctgtaatcccagcactttgggaggctgaggtgggaggatcgcttgagcccaggagttcaagaccagcctgggcaacatgataccgaaactggcaacacccagagacatttccctcctagtcataaaggaagccagcagcagagccagaaataatattcaaattctggatccactagaccatattgcccgtctgacaaattatacgcttacatcctgcttcagttctaataaggtacccacaatgccgggttctctacccactgggagcaaacaagggaacgtgcagacgctggacagcatacgatggatgcctgcaactcctgtacctgcccccgaatgccaccagaaatatgccatctctactgaaacagcttttccaaccctgagcacgtttatgaacacggaaaagagtgtaaaggggtcaaatgcagactttacaaaaagaaacccaagatggagattcctgttggggatatactgcagcctacatcatgctatgacaattttcatataaagatgctgtctcggaaagaaaaggattgggagtttgaatgatctatggcttccattccaaaaaggattactacagaagtaattactttgaaagaaaagtgataatatgtttttggagaaaggtggaaatgaagcaaggccctgaatatattaccaagatgcatattacactgaatgaaatcatccgttgcccttccggatctatcccgtggatgcagagcaagagcaacccatctttgttcagcatcccaggagacaggcctctattgacagcatcagtctggctcctttgccctctgatttcccattgaatgtggccagtgggagggcccagcagatggagggccaggaggaggaagagtctgcagcatttgttctcctggctcccaccctgccaggtctctgtctgacagtggctcacgcttttccacagcccctgtcaggtggcctctcccaaagtgacagtgttcacttggttctgtaagtgttttctccattgcctcttgccagggagggtaatggcttcctagagccagatgccagcacctgaggttgcccaccaccccatgctgtttcccttaaccctgcctacactttcaagaattgaaactctttgcagcctccttttttttttttttaaaaaaaggtactatcgatttcctaaaggaccgtgagtgatatacactcagagattcttttgtcatgttactttccgtagctcaatatggctgttatccacattatacaaagaacataatacctaccttaaatttttaatattttgtctttattcttcaactctgtgtagcatttccttctggttaagaacatgcagataatccaaataaacagatttgactaaaagaaaaaaaaa

SEQ ID NO: 1284 - DNA, 1478 bp, Homo sapiens
ctcctggggcagaatggaacagcctgggcccagggctccggatccctctctctgccaccacaacctccagccaacagatgaccccaactgggattcctatgctaccactatgaggactgcattcacgcctaaaacaggagcagtgcctgccttaattcgccaaaacggtatcagaagattaggatatacatattcacttagtgatcctattctcaatcagacacaatatagtgatgagtacacttggaaatcacactctaaagaagatttgatcaaaactgagacttcaagaggaatcaagagccacaaatctcatctcaatgaagacattttcctgtggacactacctcactgtcaacaaacggggacactaaagaactgcctcccttggaaaatcccggcttcaatgaaagaagttaacaaggcactatcaaatcagtttatttcccttactaagagagactttgtggacagatcaaaagctcagaagattaagaaaagttctcacttgtctctggaatggaaaaagttacttccccaacctccagacactgaattccgaaggaattaccaaattccagctaaaattcctgagcttcaagatttcagtttcaaatatggatgctactcaagcttgcctgttgcttctcagggtctagtgccttctgtgctgcacagctacctgaggaaccaagagcacacaaagaaacagaccacataccaaagtgactacgacaaaacctacccagatttcttaatgcttttaaactcatttacttcctctcaagtcaaagagtaccttcagagtctttcctacaaagatagacaaattattgatcgctttattcgtactcactgtgacactaacaaaaagaagaaatgaaaagggaaaatagtacaaatgaagaaaatctgaaaatcaatggaagcacgaggacattcctagtcattttctcaattatcaaggaaaaataagatgcaaatagcttcaagtatgatgtgatagtcatgaatttgtgtcttttgctccgctttatttttaaacaataaaattaaggctacaaaattttccctgaacatagctttagctgtatccaatagtttttgatacaatgtttttttcttttcccttttggatacttaatttgtagtttcaattttgatttctcctgtgaactaggaattatgtggaagagatttcttaatgtcccattaatcagagacttaagaaatcattttattgccttatctcttctttgaatgaatgaaagtttaaaaatctgcttttgggaaatcaattgcagttttatttaatgccattaatcaagtatatgattaatttgtgtgttacgtgaatatgagaaaaaaattatagtttattgtattttttaatcccttatatctttaattgtatacttgaattgttcaattctgaaagaatattggaacctcccacaataaatatatttttatcaatt

SEQ ID NO: 1285 - DNA, 1689 bp, Homo sapiens
ccaaccctgcacctggccctctaaccaattctgagtgcccgtagaaaaatgtacatgtaaagacaccagattttagggaagtaattctaaatgtttattttagctactgaatgtgttcattcatagtttttgtgtcatatccatgtctgccaactcacctttcacaacagaatcttcttttcagggagatgtcctttgcttctcagatgtaaatgcactttaagtttgttattcaacagtgaaaatgagtcatacagaggtaatattttcgtatgttctgcatcttcagggttcctggttttttgtttgtttgtaattatgtggcttcagagtaattttattttcaactttcactgtgggaggcagtatagcataagtggttaagagcgaggaatctagagcagactaccctgagtttaaatcctagctagcggctatataaccttgggcaagttacttaatctgctgtgccttatctataaaatggggataatgatagtgcttgcctcacagaattgttagaaaagtgaaataagttaatacatataaagcacttataataatacccgacacagtaagcacttaactactattattaatatcactactttttatttggaggctatgacttgaattatgagcctcacagagcaaacatatatatagctgttcagttgtcttaataggcaagaaagtaatttttgatccctttattctcttgaattccaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 1286 - DNA, 1038 bp, Homo sapiens
gtcgcttcgagcgcgctagtcagctccctgaagggagtgacggcggttgggtgcccgcggccacttttgccttcccgggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 1287 - DNA, 1165 bp, Homo sapiens
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 1288 - DNA, 3241 bp, Homo sapiens
acactgaataggaatggcagcttttaaaagtgggggaactacagtatagggtataggataaacgatgggacaaaactggaaaagacaacaaaagctttggaatgttccacaacttccttttattcgagttcctccctccatctatgacacttccttactaaaggccctcaaccaagggcaacagcgctacttttacagcattatgaggatttacaactccaggccccagtgggaggccctgcagacccgctacattcacagccttcagcaccaacagctgcttggctatattactcaacgggaagccttgtcttatgctcttgtacttagagattcaaccaagagagcctcagccaaggtagctcctcaaagaaccattccccggaaaacttcagccatgacaagaagatgtccatcagtactacctgtatctgtggttctacctagggcccaaagtaaaaggcgccaagtgctcaggaactgagacttggcagcattttcagaaacaggaagtttgcccatgtatccctggtatctagtgggtgctttgtgcatatttgttgaatgacagtgaataatttctaatataaaccccagacctaaaaataatctctgattcatataaattttgccagcaagaccaagaggtttaagagcaatggagccgagagtaagcaagcctttccacataacatccgtagagtaaaaggacttttaaagctttcaaagtaaaagtttactttggattagaacctcctagagaagtccccaaaacagtgaaaggggacaagtgaccagaaagggccaggtcctctgtcactgggtgaccatttctagcaaactatcatgtatacattttgaaaatatacaaaacaacacaggattaacactgatcatagagggcttacaaaatcatatcatcccagcaacaattggcctgtgcatttccttcctctcctcttccccatcaggcaatggcatttaatttagccccaaagctcttctagttctcacctggcttgatcactttgtgtcatcttgaaacatgcacttatcagtctaccacagctgaattgattttatggagctgtaactggccttgacatgggtaagagaattcatgcacacatctttccctggcagctgaagaaacactcttaaaagaatatgaaataaccccgaagactttatttcatgtccaacctttctgtggcctcaaatgttttaagcaaagcacataaaactatactaagcagtgagtcagttcatcatacaaaggcatagtattgcattagttatatttaatggttattttcatcaccagagattttgtgtgtgtgtgtgtgtgtgtgtgtgtgtgtgttaaaaatcagtcaccagtgctcatgtaaagtcaaaacaaaaaaatgcttcttcctcatcattgtaaaatacgtcaccccattcaaatcagctgatgcctatgaaaggaattggttgaggtggaatataaattttattgacaagggatgtgctaacattgatctgaaaggaatatgctgcattattatcagaaaaaaaatcattatcttctctttgcaatcatgaacatataagatataaaaattgtcatgagattctgaacactagtattgaggtccagcactacttccaagctcctatctgacttttctttgggaggaatgggaagtgtggttggcccactagtctgataagaagtcttggtgaagctaatactgaccttgctggggtcattcacttaatcataaagaagcttcttgacctctgcaaattctggccctgacatgtattctaaatacctttacagttctaagtgagaaattgttacataggcttagaagaagaaaagactccagtgggactgggatgagctgcgtggtagccctcataaagcagagaggttggtgggagacctaacttggcctatactagccttcccattgttttcacaatgggccttttatcccctctgaactgcttgcctgcacttttatcttagacttttttttttgatgagcataggtatttgctgtgtaagccttatctagtgatgcagaatatcaaggaggccacttacaattctaagctgcatccctgtatcaaaaatctcagaagcaccttgcatctgatagaggcttgtaagagcagattgacaggtgaatgtcacaggtccataagaaggacaaatagatctaagttgggcaaaagattctatttgttggttctcccttctaagatgataatatgcccctgcacttgagaccttacttgaaacttaaagaaatgtgattggttatggtgctgggagaaaggggtgcacctgggaggacactgagaaagataaacaaaggggaaggaagagaggacaacctgtaacttttagaaaaggctactacttttaactgttggagaaaatgctattgcttgcactcacaatgtcaatatacattatcagaacttaagtcctggagatcagagactgtttcacctgaaattgctagcacctagaatggcccccggttgcggtaggcaatcaataatactctttgaataataatgaggttttcaaagattctgcaagtcagactggcctctggctttgtgatattattctagagtcccagtaacccacaattgttgatgaggagtagcagtagaatatcaaggacaggtgatgagacaacaagtctatcccgcaaagggcagggaatagagggtacactggaaagaatttgaaaacaataataaagctgactacaagttggtctattttttattaccaccatgagccagcaattctaaataatatcagtgataaagtattcatcccccaaaatattttattgaactaggttctaaacaatttctgaggttactgttgagttttaaataatacatatatgtaagcttcaaagtagcacatttgtactgtttttcttcaataatcattttactccacatggaaactaattcagggaatatcctgctatatagttggctctcagtacatatggtgtcagctcatgtgtctccagcccctgtagtactatatattattgcatttaaatgatggatttgaaataaacaatgattataccatgattgtaaagacaagaaacagaacctgaaatacttcaatttttgattctatgtggcagtttagagttttttaaaacaatttttatgtataatttatatgcaataaatgccctcaaagttc

SEQ ID NO: 1289 - DNA, 3300 bp, Homo sapiens
atcagcttatcaacagacttccaccaccaccaccagcatataaacagagtccgcgtaagaaaactacactgaataggaatggcagcttttaaaagtgggggaactacagtatagggataaacgatgggacaaaactggaaaagacaacaaaagctttggaatgttccacaacttccttttattcgagttcctccctccatctatgacacttccttactaaaggccctcaaccaagggcaacagcgctacttttacagcattatgaggatttacaactccaggccccagtgggaggccctgcagacccgctacattcacagccttcagcaccaacagctgcttggctatattactcaacgggaagccttgtcttatgctcttgtacttagagattcaaccaagagagcctcagccaaggtagctcctcaaagaaccattccccggaaaacttcagccatgacaagaagatgtccatcagtactacctgtatctgtggttctacctagggcccaaagtaaaaggcgccaagtgctcaggaactgagacttggcagcattttcagaaacaggaagtttgcccatgtatccctggtatctagtgggtgctttgtgcatatttgttgaatgacagtgaataatttctaatataaaccccagacctaaaaataatctctgattcatataaattttgccagcaagaccaagaggtttaagagcaatggagccgagagtaagcaagcctttccacataacatccgtagagtaaaaggacttttaaagctttcaaagtaaaagtttactttggattagaacctcctagagaagtccccaaaacagtgaaaggggacaagtgaccagaaagggccaggtcctctgtcactgggtgaccatttctagcaaactatcatgtatacattttgaaaatatacaaaacaacacaggattaacactgatcatagagggcttacaaaatcatatcatcccagcaacaattggcctgtgcatttccttcctctcctcttccccatcaggcaatggcatttaatttagccccaaagctcttctagttctcacctggcttgatcactttgtgtcatcttgaaacatgcacttatcagtctaccacagctgaattgattttatggagctgtaactggccttgacatgggtaagagaattcatgcacacatctttccctggcagctgaagaaacactcttaaaagaatatgaaataaccccgaagactttatttcatgtccaacctttctgtggcctcaaatgttttaagcaaagcacataaaactatactaagcagtgagtcagttcatcatacaaaggcatagtattgcattagttatatttaatggttattttcatcaccagagattttgtgtgtgtgtgtgtgtgtgtgtgtgtgtgtgttaaaaatcagtcaccagtgctcatgtaaagtcaaaacaaaaaaatgcttcttcctcatcattgtaaaatacgtcaccccattcaaatcagctgatgcctatgaaaggaattggttgaggtggaatataaattttattgacaagggatgtgctaacattgatctgaaaggaatatgctgcattattatcagaaaaaaaatcattatcttctctttgcaatcatgaacatataagatataaaaattgtcatgagattctgaacactagtattgaggtccagcactacttccaagctcctatctgacttttctttgggaggaatgggaagtgtggttggcccactagtctgataagaagtcttggtgaagctaatactgaccttgctggggtcattcacttaatcataaagaagcttcttgacctctgcaaattctggccctgacatgtattctaaatacctttacagttctaagtgagaaattgttacataggcttagaagaagaaaagactccagtgggactgggatgagctgcgtggtagccctcataaagcagagaggttggtgggagacctaacttggcctatactagccttcccattgttttcacaatgggccttttatcccctctgaactgcttgcctgcacttttatcttagacttttttttttgatgagcataggtatttgctgtgtaagccttatctagtgatgcagaatatcaaggaggccacttacaattctaagctgcatccctgtatcaaaaatctcagaagcaccttgcatctgatagaggcttgtaagagcagattgacaggtgaatgtcacaggtccataagaaggacaaatagatctaagttgggcaaaagattctatttgttggttctcccttctaagatgataatatgcccctgcacttgagaccttacttgaaacttaaagaaatgtgattggttatggtgctgggagaaaggggtgcacctgggaggacactgagaaagataaacaaaggggaaggaagagaggacaacctgtaacttttagaaaaggctactacttttaactgttggagaaaatgctattgcttgcactcacaatgtcaatatacattatcagaacttaagtcctggagatcagagactgtttcacctgaaattgctagcacctagaatggcccccggttgcggtaggcaatcaataatactctttgaataataatgaggttttcaaagattctgcaagtcagactggcctctggctttgtgatattattctagagtcccagtaacccacaattgttgatgaggagtagcagtagaatatcaaggacaggtgatgagacaacaagtctatcccgcaaagggcagggaatagagggtacactggaaagaatttgaaaacaataataaagctgactacaagttggtctattttttattaccaccatgagccagcaattctaaataatatcagtgataaagtattcatcccccaaaatattttattgaactaggttctaaacaatttctgaggttactgttgagttttaaataatacatatatgtaagcttcaaagtagcacatttgtactgtttttcttcaataatcattttactccacatggaaactaattcagggaatatcctgctatatagttggctctcagtacatatggtgtcagctcatgtgtctccagcccctgtagtactatatattattgcatttaaatgatggatttgaaataaacaatgattataccatgattgtaaagacaagaaacagaacctgaaatacttcaatttttgattctatgtggcagtttagagttttttaaaacaatttttatgtataatttatatgcaataaatgccctcaaagttc

SEQ ID NO: 1290 - DNA, 2374 bp, Homo sapiens
ctggggtcgtggccgtgggccggcaggggcgaggcgggcgtccagagggcggataaaaggggccgcgctgcgccggggccgctttctccgcgcggtgcctgcagggctcccagcgagtggcagcttgggaggggccgcccgggcggtcagactggcacctgagcggccaccgcgtcccggccaggcgggcagaccgaccccctcctcacctcgcgcgcggctgacgcaggcagggcgcccggcccctcctggggaccatcaggtgccggctgggggctgtaggcaccggacggaagcaggcggtgtgaggaccgacgacgcgggcatggcgggggcggcctgcgagccggtggccaggccgagcctgacctccatctcgtctggggagcttcgcagcctgtggacctgcgactgcgagctggccctgctgccgctggctcagctgctgcgcctgcagcccggtgccttccagctgagcggcgaccagctcgtggtggccaggcccggggagccggcggcggcgcgggggggcttcaacgtcttcggtgacggcctcgtgcgcctcgacgggcagctctaccgcctcagcagctacatcaagaggtatgtggaactgaccaactactgtgattataaagactacagggaaactatattgagcaaaccaatgttgttctttattaatgtacagaccaaaaaagacacctcaaaagaaaggacgtacgcgtttcttgtaaacacgaggcaccccaagataagaagacagatagagcaagggatggacatggtcatctcctcagtgattggagaaagttaccggcttcagtttgattttcaagaggcagtgaagaatttcttccccccaggaaatgaagtggttaatggagaaaatttaagctttgcatatgaattcaaagctgatgcattatttgatttcttctattggtttgggctcagtaattccgttgtaaaagtaaatggaaaagttctgaatttgtcaagtacaagtccagaaaagaaggagacgattaagttatttctggaaaaaatgagtgagcctttaatccgaaggagcagtttctctgaccgaaagttcagtgtaacttccagaggttcaatagatgatgtttttaactgcaatctgtcacccagatcatctctgacagagcctcttttggcagaattaccatttccaagtgttctggaatctgaagagacacccaaccaatttatctgattgaactgaacattgtagcagttgctcccgcactccaggcctgtgctagactataggctggggggagggtaggaggtgggaggcagatacttccacctgcgtgtcaatctccggctcctccatggcttctatggaggactcctctcttctgcttctgtggatgtgatgccctggcaggcccagggcagctgattcccctaaaacttatgattaccaggatggaaaggccttggtcccatggcactgggtggggctgggggatattctctactttgaacacttctccaaagaggcagaagggccacagagttctgccaccctgaacatttttctcagttccctgggagtttttgtggcagcctttgtgggagtggtctgactggctgttgacctagcatgcttcataaatcagggtttggccctctgcttggagcatccaaccccttgaactcaaacctgtcgagcaaggggttaagagttctgttctcttgccaacctggctgggcaaaagcctgtgccatctttcactgggaggcaaatatgtttttcatcctgccatatgacacctatgagaaacgttcacagtgaggagtagccaggttgctaggacagtaaccctgccacacactgcctgaaatcggaactcccttggcctccctcttaactaagtgacccatgtagaaggaagccaggagatatggtaccgaacaatgacaggggaagggtattggacacggcagcgtcctccttattgaaaacacattatgtcagttgggaattttaaataagcttttagcaaacctaacactaaaagcaaaatagaagaaagctataccattaccataatacatttttcatctcatggctacaatggaattcttgaaaaggaaaaaaaaatcctatctacatataaaaacctgcatgaatgaatcactacatatgcttataatgaggaagagttatgggtcctgagtgtaattttttatcctttcttaaaaagtttctgtattatgcattttgataacactactgatgatccttccacttatatttgaaatgttatgtaccacatttgcacaattaaaacttttcttagcattcaacctagaattgattaaatttatgactgaggcttca

SEQ ID NO: 1291 - DNA, 2241 bp, Homo sapiens
agtatcaaaaacaactgagaaaggggccgcagctccggccttcatctgctattgcaaattcggagcagggtgctactggggggtgggggagtaaagagaacgggccctttcttcgtgtgtccacttcgtaggaacccaggcaagagtacccaagcagacctctgcttaaagcaaaaacagactgaagttgttttcccctcaacacggtgaccatccccaggtttagcagagagaatctaaacaatgacccttgcaaacacagcaaggataccgacaaacgctggaaagctcagctgtggagttttagtcgtggctgagtttaggtggccttgcttcaacgccatcagggttttgaacaccgtcggggggaagacgccagtctgctcaagtggtgcccaaaccagaaatgccagtgtcatgtccacgtttccgcttcttcggagaagggacctgtctcacacgtccagccagagcttctgagctggagatgcaaccctgcgacagagaagccctggtttgtaatcataccgagcttgggcaaggaggccggaaaagaattacacagaagaaaaccaaccattcgatgcctttcttcttccattcccaatcagaaggttgtttctgacccattgaaatattacctacaaagaagacgggagcctcctgcagcagcctctagtgatctgagagctgaaccaaggtttgaggcccatctccaggtggtcctgaatatccgtgcatcctgggaccttgttaggatgaactcaccagaggcgaggctctgcgttgctcaatgcagagactcttacccagggtgtcagcctctgaaagatacacgtgcctgggcctcttccctgaagatggacccggcaggtctggagggaggcccccgtgatgaatcccgtgatgagccgccgatccgagctcaggctgcgtcatgggaccagccacaaggttgcctgacctataaaggtcgcaggagtgcctcagggacacagaagcagttacagctgccagataccctatcatctttactctgttggagaggagctataatggtctatattaaagttactgttcagacagatgattccaacaaattgctttcattactttatcggtaattttaagcactacacaacttagttgtttttttctggaagaaaactggaattaaaatcattgatcctttagagaaataaaacaaaggagaagggagtgtacaaaataaataagaaaagaattcttaccatactttcctgtattcttactgagaaataaaaatgggacattgagaagcaaaattaatcccgattaggctcgctttgggacaagcaaccactttgcatgattacccatcgttaggtgtgaaacggagccaatgatcgctcattgtcgaggagaaaagacctggagaccacggcttatccagtctcgctcctgacctgcatctgaacacctgaaggaagaaactttaacaagaaaaagacttcaagtgacagaggagacaaaagtctcaaaggtgcagaattcaagaactcatggtgtctcaggatgggtgtgaaagtaacaaatatgagatcccctgacaactaaacccaggcatgtccaggaatcccgggatgcggtgaaagttttcacagtggagctcacaggaatccccagatgccgtgaaagttttctcagcggagctcacaccagcattgtctggaatattaaatgttgttatgctttgagattggcacttatgccattcaaatttttttattaagaagtacaatgaaatttaacttattccatttttgacaccaatgtaatgaccaaattaaactagattttcaaaaataatcagaggccctgccccacaaactcctcctgggcacaggaagatgtggggccagtcagtagtgactcctcttgggtgctgatccaccatgctgaattcagaccggcgccagtcccctgagcgcctcccaattcctatgtgatttcctgtccctagtatatgaacatgtcagccttgatgtgatcacacaaattatgggccatgacgcatctaccactcttgcctgttctgaagggctgcctttagttgtcttgcaaagagcacttacacctcttccctacggcacagaagccctgggtctggggtgacaggggcagagacctgcctgtcctccagccacccaagaccatgcttctgtctgtaggttcccccaataaaacaccctttactgacag

SEQ ID NO: 1292 - DNA, 5828 bp, Homo sapiens
ccccttggccccgccccaccctgctttgccctgcctctccctgccccgccgcgccccagtcccttgacgaccctcctctctgggccccgcccctcccgcttcggggtcaagccccagagagcgccgcgaaaaccacatttcccagagtgcaccgcgacggcaggggtcctcagaccggcgctcgctcgccggcgccatccctatagagaagaacggaggtacggcctgtggtcatggcgctgttcccagcctttgcggggcttagtgaggctcccgatggcgggagctccaggaaagagttagactggctgagcaacccaagcttttgtgttggatccataacgtccctgagccaacaaactgaagcagctccagcccatgtttctgaagggttaccgctgacaaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaatcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtgaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgccgctggaggagctggagctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtggcagcgtccttgctcattctctccctgtgcgcagccagcactggcccccgcacggtgaatgtgttccctccgctggtgtcgtggtggtcctgccaggccctctctgagataaaggtctggtttttcagcactaggatgtcttccccaggctggtgagcaggagattttgctcttgtgttgagacccgcagttaacgcttggtgttctggcctgcacgcagtgtgtggcaagttccctgagtttacctcggcggcgatgcctccgcctggagctggaggggcagcgtgccctggggctgctgaaaaactcaggcctgtggagtcagaacccgctcttcagcaggtcccaggccacttgagtgtggaaggctgcccggggcactggcagcctctgggggaagcctgctcccaagccgtctaggagccgagcacgctgtaccgccagccccagccctgcctgcatgaggggcccggcacgcttgtgcagcaacgctgcttacactatgaaggccaaggctggcctggttctggtgttgcattcgagggctgtgaacagaatgaaatgtcaacatccatttttcagacttgttctgcctccgaagagatttttagtgctgagtgattttcactattaacatatggctggaaggaatggttttcttatcttctccgagctctagactggctagcttctctctggctttttttgttttgttttcctctctttagaattgctgtatacttgtatctcctcagcacatttagaaaagccagtgtataattttggctggcaactgacggacgcagcgggcagcagcaggcagggcagcgcacgagagcacctcccagggcacggtgggaaactggccagcccagccccactactgccctctcctgctcgtccccagtccctgagctacaggtggctgtaggcagaagcccaccgggtgttccttagcgacagacaggtcgtcagctgctccccttgatgccttttcacagaaacaaccctcaacttgaggaagttgagagctccactccgaggtggacttgctccccctccctgagagctaactggcttgaactgtcatgagttcctggctgcccacaaagagggaccttctccacccttgtcctctgcgtggggcagacatcagccagacatgtcaccgacctgattgggggcagggagtaggaagtccaggaccaaaccatgctccccatgacagcagctggcgcctcagtccccatctgactcatgtctcttctcatctggttcagaacttagaagggcgtggcctctgatcagctggttccctccaaaccccagtggcaacctgtcccttgagagccaggaatggctcttagcagtgggcagtgagcccccgagaggataaagcggctgctcgaacagattgcgagcacattacttgctgcatgggaggaggtttaaaacaaatcaaagattccttgagggcattttacagaaaacaagatgtcaagagcatcactgttgttatttaaaagcccatttgaggccaggcgcggtggctcacgtctgtaatcccagcactttgggaggccgaggcggacggatcacgaggtcaggagatcgagaccatcctggctaacatggtgaaacccccgtctctactaaaaatacaaaaaattagccgggcgtggtggctggcgcctgtagtcccagctactcggaaggctaaggcaggagaatggcgtgaacctgggaggcagagcttgcagtgagccaagatcgcgccactgcactccagcctgggcgacacagcaagactccgtctcg

SEQ ID NO: 1293 - DNA, 3465 bp, Homo sapiens
atagagaagaacggaggtacggcctgtggtcatggcgctgttcccagcctttgcggggcttagtgaggctcccgatggcgggagctccaggaaagtcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtgaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgccgctggaggagctggagctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtg

SEQ ID NO: 1294 - DNA, 3082 bp, Homo sapiens
tagaaggatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaaaagcttgaacccattgacttgccacgagtaattacttcaggaagactcctgagccagcgagaagccaggacaatgcacaaagcaaagcaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactactgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatcactttggtaaaaagaaatgatatctttagagtcttatgattaacaagtccgtcacatgtgctgttaactattgctgcataactaaatgcctcaaaacacaggggctaaccaagagccattttattgtctcactttcctgtgggttgctgagttcagctaggtggttcttctgctgttcccttttgaaatctttcatgtcattgaaattggactacatttggactactaagactggagtcatccagaggccccattaggacactgacacagggggaccttgccccctatccatgtagcctcagagcatctgcatatgatctcttcagcaggacactgcagagatttctctcatatgagcccagggctcccaaaagcaattgtctcaagaggaggaaacagaagttgccagtcttcttaaaagctagtcatagaactgactttgcatcacttccaccatgttctgttggttaaagtcatagaccagcttggagttaatgcagaagaggactacacaagggcatgagtgccaaagtgtggtcctttggggttcatctttgacatttgccacctcaccatgtttttaaaaagaaaattagattacataaaacaaatagatgggctggatgtggtggctcacacctgtaatcccagcactttgggaggccgaggtgggcagatcacttgaggtcaggagttcaagaccagcctggccaacatggtgagacaccgtctctactaaaatacaaaaattagccagacatggtggcattcgtctgtaatcccagctacttgatgcgaaggctgaggcaaaagaattgcttgaacccaggagatagaggttgcaatgagccaagatcactccactgcactccagcctgggcgacagaatgagactctgtctcaaaattaaaaaacaaaaaaccaaaaacaaatagatgaaaaagtagactggagacaaataaaagtgagtttctaaaggaaattcacagtaatgctgcattaaacactaagctcacttaggtcactttctagtgagctaaccgtaacagagagcctacaggatacacgtgagataatgtcacgtgtagaagatcgttgtgaattaaagttcaaaattaagacttcttagattatgatgtagattttagagctccttaaaacataaagcgaatcttataaatgttcaattctaaagttattccacttggaaaaattagcttttgggacaatttttaagaacttttgtgtaaaatgcagctccatgtttagcataatctaaaaataatttcaagcaatccagaatcttccaagaatttattaaagctttaaaacaaagcaaaacaaaaagacccttttgtgccttatatgggaagactccaaaaacagaaaaaaatagaggaaaacaccacttcaatttgacattcaatgcattcacatcagaaactaagaagataacaagcctgagatgtcaggtgataaaaattcatgtttcttccaaggacagaaggctattagattgtcccaggccatatctattcccagttctttgtgagtagtcttcttactttttctgtggtaggtaagaagcatatttccaccaaaagaaagcatgcattgtttgactagccagctttctagaaaaaatgagatccttgagaggataaacaaatccaacctattcatggtgtcctcacttattgtggtcaatttggaaggcttaaaacacaaaaaatgggatggataactttgaacactaaaattagtggagccaaaggcacgtcttcaccattctgttatgtgacttaaaattcaatttcacgaaacccacttccacaagcttaatgaactgtgagctacatgagggcataaaccatgtcttctttgtatggtatttctgcttcctagcaggacagctggcaaagagtttatcattaaatgtttgctgaattaatga

SEQ ID NO: 1295 - DNA, 2452 bp, Homo sapiens
cggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagaaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaagatcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgccttt

SEQ ID NO: 1296 - DNA, 2438 bp, Homo sapiens
ccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaagatcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgccttt

SEQ ID NO: 1297 - DNA, 2456 bp, Homo sapiens
gaggtcagagagggaagccccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattaccctcggcagaaagatttctggttaccatcagctgggaaaagagaacgaaatcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaagatcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgcctttata

SEQ ID NO: 1298 - DNA, 2112 bp, Homo sapiens
tactgtataaggttctatacctggtagcttccaggtggtagttggtaccagaatgggcgcaaacttagtctcttctccattctgacttcaaacctgggtcactacaatttcttggatcacgaaaactgcattcttccttaaatggtgtcactaagttgtctttctgtttctttctgccatggtcattgtcagcagtgaccccaggccaaagaacagtttttcattcattctcaatacctcgatgagaccatgtgctactctgtgtttccacaactctagtgtgattttgaagttgtatgtttttctgttcctgtctagtgagacagtctctaatctttctggatctcatcattaggtaattcaatgacaagtttaattggggaaaagagagaaggatctagtcccccgaatttgttttgggtcctgtcccagttgtcttctggttagtaggtttttgtgcttaagaatatgttgacttcaggcatttaacaagggacaaaacatctatttttagtgacttaaggaagtggtaggaacagaatctaagtgtagccagatgaaaggtgacttattttgtttagacaggcagaactgtggactaccatgatctgtttcatcaaattattccaaaacaacagatcctttttcaggctttctttttctttttcttttctttctttctttttttcctaaacttccttttggcagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcatt

SEQ ID NO: 1299 - DNA, 1458 bp, Homo sapiens
agagagggaagccccggcggtgagagtcggcccaaaaagcggcggccgttggagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcatt

SEQ ID NO: 1300 - DNA, 3654 bp, Homo sapiens
gggctcgcgctgctgccgttaaggcgggaaccggcgcgatctccattccagcgcgaacctcatcaaccaccgtgcgcgcggatccagaggctcgcgctggcggcctgagcgagctcgcgccgagcccggatactgcgcctgcgccgcggcagaggctcgtctctaccgggtccgctctcctccgacaccccagcaacgccgactcctcacccctttgagccgcttgaccagggcactcttctgcccgctcttggctaggcctcgctgctccagtgcggccttcaggtcggtcacccgcagcgcctgaagaggcttcccgtccagagtcacctcctccagctccgccatcttgcgtgaggtactcgggtccgtcccgacggcttcgggcatcttcggtaatttccgccaacgcccttcgaacgtaccgagatgaccccgcccactgccatactctacccctcgattaccactcagaactccccgggttcctccggatgtcctcggatgtttccgtctccacatcgttaccaatcaattctttccatccgccctgcagcgccccttttctcgccctgctttcaggctcggttttcttcgtcttgccgaagctttgaatcgaatatattcggaaaccctcgaccctggtataaccataatcggagatgttcgtttatttccggacctagagatgaggcgctggggcgcttgggtgtttggggcgggtccgaggccggaagtgcgtgggctgccgggctggcccagcttagggttttcaggaaatttggaagctgccgcagtagttggagtctaaggactcgtgacaatcttcgggtgcccttcgagagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtccactgctggctcatgaaatgtgtaaagtagaaccctccttcccgagaaataagacaggacaataaaaggtggcgtttttgtactttacctggattccattggctggttttaccactcctatcagattgtagtgtaattgtgtgatacgcaaaccattagttttcccagtgatgatttaataaaattatgaaaaatcaggagagggagataattagttgcttcctccttcacactgtttgaatcgaactcgcggtgacttttttttttttttaaaaacatgggttgtcacttaagtttggagtgcagtggcatgatcatcagtgagcgtgagatcactgtaacctcaaattctaggctgaagtaatctttctgcctcagtctcctgagtatctaggactacaggcccgcacaacaatatctggctaatttttaaattattctgtagatacaggggtcatgctacgttttctagtctggtcttgaactgctggcctcaagcgatccattctcaccttggcctcccaaagtgctgggattacaggcatgaaccatcatacctggcctttttctaaggcatatgtatgtgatattcttggaactggtagcaggtgttcctattctgtaagtttgctttacaacaatacgaaaataagtgacaatttacaggttgaacaatttatttttgtaccaaaataaagaatggatctttagaactgtaaaacttcacccttttttcattgccaggctatataatattgacaaccggggaaagaggcattccaaagaaagtagaaattaagtatacacaatagattttccatccagttgtctcacaagaaattattctcttccttaccccctgtcatgttctgggcaacatcacacctcccttattcctctaactgggacccttgtgctgtggagctctggtgaatggtaagaggcagatggtctcacaggaagagtggctcttttctggtaggctgtggttcccattacacccaccaggattagcagcattaggcagagtcccatggacagccttaggtgggtcatggagggattatggtctgaagtaaccagcaacctaggaacatagaaggtaatatttggcatggaataatgcctagccttagtagataaagcggcattacctttttttttttttttttttggagacaaggtcttggtctgttgcccaggctggagtgcagtggtgtgatcttggctcaccgtaatctccgcctcccaggctcaagcaattctcctgcctcaaccttccgaatagctgggactacaggcgcacgccgcaccaccacgtctggctaaggggctttacccttaaagatagagctcatgaagccccgcctcatccaagcattaagctaaacaggaaatcattaagagggactatcgaaccttaaagtagaaataagatcaagatctaagtcttctagcatcttatattattggaagaagacctaacttggcagcaagggaagtggcttaagggaagagtcagtctatgttctttaggtagctagacacaatccctaacagtgcttaagaaaggaagggggctgggagtggtggcagtggctcccagcactttgggaggcagaggccggtgggttgctttagctcaggagttggagacaagcctgggcaacatggtgaaactgtctctatcaaaaatacaaaaattagctggcatggtggtgtgcacctgtagtcccagctacttgggaagctgaggtgggggaatcacttgagcctagggaggtcgaggccacagtgagctgagatcaccccactgcattccagcctgggtgacagagcgagaccctgtctcaaaaaagaagaagaaaaaggtggggggaggggactaagatccctatgtcctagagatgggggaatgtgttattgtatgggaggagggagtcaggtagtgacgggactggatgatcgtgttagggatctttgttctctgaaacgcaaccctgtctaggacaatatacacgtgagtgagtgcttaataaatttaatttcaaaca

SEQ ID NO: 1301 - DNA, 725 bp, Homo sapiens
agcttagggttttcaggaaatttggaagctgccgcagtagttggagtctaaggactcgtgacaatcttcgggtgcccttcgagagaaaaggggagtgcttttatgtttcaggatgccactggagtcatcctcttcaatgccactatccttcccatctctcttaccctcagtaccacacaatactaacccttcccctcctctgatgtcttacatcacctcccaggagatgaagtgtattcttcactggtttgccaattggtcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatgactctctacaatgataactcaattcaaatgtgtcgcctaaagctctggaactggtattccaaccagctgaccgaactcactgaccagtacaggcatggttatttcaacattaatagcatgtcaactggactcctatttgtaaatg

SEQ ID NO: 1302 - DNA, 1154 bp, Homo sapiens
atttccgcctccgggtggcgcttcccggtgtcgtgttctggaagcttagcggtcaccatggagctgctgggagagtacgtcgggcaggaagggaagccgcagaagctgcgggtgtcctgtgaggcgccgggtgacggcgaccctttccagggcctgttgtctggcgtggcccagatgaaggacatggtaacggaattattcgaccctctggtacagggggaagtgcagcaccgggtggcggcggctccagacgaggacttggacggtgatgatgaagatgatgcagaagatgaaaataacattgataacagaactaacttcgatggaccatctgcaaaacggccaaaaacaccgtcttaacaatagccttcatgacatttaaaagatggctgttgtatccttattgtcacactaggacatttaaggaagacttatgctctaatttggaaaaagcatttgtgttgttctcctgggacaattttgtcaaagagaaaactggtttttctgtttctagcaaagatagtaaaggcttagaaataaaatctgttttcttgagaaataaatttcagaccctggaaggaaaatagaacacttcataatgtataaaatcctctaagttggcaactgaatttttatcattgttttctatttttaaaataatcattgatttgtgtgatgtctacatcttttaacttctggttctgttataaagagtacatgtcacggttcataggcagtaacatttcagagaactgacatgaacaagtagtgaaaattgggcattaaatataaaaataacagttcttcataaacagaaggaaaataaggaaatagaaataccgacgagaaaggagagtccttgaaagagacccaaggaaaccctgaattcatacccacgtcaaatatgcacatatcctgagatgatgccactttgatgaatgtgcattagtctgatttatcatgtaccttaagagagccagatggggtatgtttttgtgctgtgatatggtatttatacaggtacaaatataaggccttaagtaaacaatctgcattgattacaatttggatatttcctctcctcctgtagccatactttgattttgctttaaaaagattattgaatccttttaaaaatatatattcctaaaata

SEQ ID NO: 1303 - DNA, 1527 bp, Homo sapiens
cgccccccggacgtggctggttagcgtcccgccctcctcccgcggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtgga

SEQ ID NO: 1304 - DNA, 550 bp, Homo sapiens
acttcatttggagatgacagcacaatctgcccacatccacccttgatggctcccgcaccgacccttgccaaacttccctatgtgtctcttgggctggaatagagaagcttgggggaaaggggctgatcaggactggtgagagggccccccaggagagggcagaggtggttgtccccaccccttctgcagcagttgccccaggcacctgttcgacattggtgtctgagacagtgttgctactgctgagggaacatcaccctggctcacctccatctttcaaaatatggcaagctgcacaaatcgcggaggcctcccagagaaacacagctcctccaaggtgtcaagccacgcccaaatgatccaaaaagcagttgattttttagaccttttaatcggccacctgagcaaattctcaccagttttgatagttttccagtttagtcccttgggttttctagttagacagtcatctgcagataatgttcaatttttgtcctttgccccctccctcattctaccaagtggcacaggaaattggttggtttggtga

SEQ ID NO: 1305 - DNA, 1025 bp, Homo sapiens
atggattggtttcattgcaaccagtgcttccgaaaagatggggcccatttctttgtcaccagctgtggccatattttctgtaaaaagtgtgtgactctggaaaaatgtgctgtttgtggaactgcctgcaagcatctggctctttctgataatctgaagcctcaggagaagatgtttttcaaaagtcctgtggagacagctttgcagtattttagtcacatctctcaggtgtggagtttccagaagaaacaaacagatctcctcatcgccttttataagcatagaattacaaagttagaaacagccatgcaggaggcacagcaagcactggtgagccaggacaaagaattgtcagtcttaaggaaggagaatggagaactgaagaaatttctagccattctaaaggaatctccaagtcggtaccaaggaagcaggtcaatcacacctcgaccagtgggcattacttccccatcacagtcagttaccccacgacccagtttccagcatagcagtcaagtggtcagtcggtcctcctcagcggaatctattccttatagagaggctggctttggtagcttgggacaaggaggcagaggtctgcagggaaggagaactcccagagactcttataatgaaaccccttcaccggcttcaactcatagcctatcttatagaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatttactattaaatgttaattttcctttctattgaaaa

SEQ ID NO: 1306 - DNA, 465 bp, Homo sapiens
atgctctactgtgaggccgaatccccgccgactgttgaaaaagtgaaaccagcccgggagaattcggaaacagacctggagattgaaggcgagcatgggcatttgggggcagtcagggcagcttctcctcagaaactggagaaatctggtttccaggagctgtcatctcactcctttccagagtctgccctgcggatggcctgtggaggaaatgtggcagaaaggcctgctcgattttgcctggagtcctcctccgggctggcaggggagagcagctgcagcttcccacgcttgtcacctgcctcaggagcagtgccctcacgtcgtcttgttaaaagcggaatcaatacacaaacaaggttttctaatcttctaaatgtttccacgtggggcatcctatgcaatctttgcaatagtcctaggagtttccccaagaagggaagcaccgaaagagaacacttgtga

SEQ ID NO: 1307 - DNA, 1648 bp, Homo sapiens
gagtcacaaagtcacaggcgggtggggatcctttcaacagggctcccagcaatagagcagtcccactctcccagatgagctggagaagtagctacctctcccagacagagttggggtcaaattcatgcacatccaattcccatcaaagcctactcttcccagggcttgctgggagggaaggataactgcaggctcccctgggatgcccccagatgagattgaaattgagccagtacgacagagcagcgataaaatgctctactgtgaggccgaatccccgccgactgttgaaaaagtgaaaccagcccgggagaattcggaaacagacctggagattgaagatgatgagaaatttttcaccactggacaaaaggagctgtacctggaggcctgcaagctgatgggtgtagtgcctgtctcctacttcattcggaacatggaggagtcctacgtgaacctcaaccaccacggcctgggccccaggggtaccaaggctattgctatagccctggtgtccaacatggctgttaccaaactggagctggaagacaattgcatcatggaggagggcgtcttgagcctggtggagatgctacaagagaactactacctccaggagatgaatatttccaacaatcaccttggtttggagggggccagaatcatctcagatttctttgagagaaacagttcttctatctggagccttgagctttcaggaaatgacttcaaggaagactccgcagcactgctctgccaagccctgtcgaccaattaccaaattaaaaagctggatctcagtcacaaccaattctctgatgtaggaggggagcacctgggccagatgctggccatcaacgtggggctcacgtcactggatctgagctggaataacttccacacaaggggagctgtggccttgtgcaatggtctccggggtaatgtgaccctgacaaagctggatctctccatgaatggctttgggaatgaggtggctctggccctaggggaagtcctccgactcaaccgctgcctggtctacctggatatcggtggcaatgacatcggcaatgaaggggcctccaaaatcagcaaaggactggaatccaatgaaagcctcagagttctgaagcttttcctgaatcccataaatatggatggggctattttacttatcctggctatcaagaggaaccccaaatccaggatggaagagcttgatatttccaacgtgctggtgtccgagcagttcatgaaaacgttggacggagtgtatgccgttcacccgcagctggacgtggtattcaaggcagtacaaggcctctctcccaagaaaaccatcttcttgttgacaaaccccatgaaactgatccagagctatgcagaccaacacaaaatcacgatcgtggacttcttcaagagcttgaaccccactgggacaatgaagatgtctgtggatgagttccagaaagtgatgatagagcaaaacaaggtccccctgaaccagtaccaggtcagggaggtgataaagaagctcgatgagaagacaggcatggtgaacttcagtttcttgaacacgatgaagccatagcaacaagtctggtctagaaagaagtctcggcgagaggagtcctcgcaagtcggatgg

SEQ ID NO: 1308 - DNA, 1122 bp, Homo sapiens
aggcgggtggggatcctttcaacagggctcccagcaatagagcagtcccactctcccagatgagctggagaagtagctacctctcccagacagagttggggtcaaattcatgcacatccaattcccatcaaagcctactcttcccagggcttgctgggagggaaggataactgcaggctcccctgggatgcccccaggtgagggaagttcacagagtttgagacagaggtgaatggacaggtgtgcttcttagggaagcagtcgagaggtggcaagaagttggcagctgccctcaagagggtcctggcaccatggacaatgacaagcctcttcagcctgagacagaagatgagattgaaattgagccagtacgacagagcagcgataaaatgctctactgtgaggccgaatccccgccgactgttgaaaaagtgaaaccagcccgggagaattcggaaacagacctggagattgaagatgatgagaaatttttcaccactggacaaaaggagctgtacctggaggcctgcaagctgatgggtgtagtgcctgtctcctacttcattcggaacatggaggagtcctacgtgaacctcaaccaccacggcctgggccccaggggtaccaaggctattgctatagccctggtgtccaacatggctgttaccaaactggagctggaagacaattgcatcatggaggagggcgtcttgagcctggtggagatgctacaagagaactactacctccaggagatgaatatttccaacaatcaccttggtttggagggggccagaatcatctcagatttctttgagagaaacagttcttctatctggagccttgagctttcagaccaattaccaaattaaaaagctggatctcagtcacaaccaattctctgatgtaggaggggagcacctgggccagatgctggccatcaacgtggggctcacgtcactggatctgagctggaataacttccacacaaggggagctgtggccttgtgcaatggtctccggggtaatgtgaccctgacaaagctggatctctccatgaatggctttgggaatgaggtggctctggccctaggggaagtcctccgactcaaccgctgcctg

SEQ ID NO: 1309 - DNA, 1526 bp, Homo sapiens
ggcgattatagagatagttaatgtcggccgtataagaaacattattaaagttactcttcggtcctttccgttcttgataaacaattcctgcgccttcctctcgaattctattttccattcctcaagtcactttaatggctcttcaatacaacaaatatttactgagtgcttactaagtgccaggcactgggctcagcgctgtgagggatgagaaagaagtggtaccttccttccaggcgattgtagtctagactacaaactgccttcctctgccaggacaagtttgtcgtctgctctgagctatcaagccccttaggagacctaggacccagctgggtcccatccctttggagtagctgcttcagactagcctaggaagcacctaattcttgtgggcaaaggagccatggaagatagagctggtgagcaagagcaggagagacacagccttcgtctggaaaagctacaacactgggcaaggcacaggcagagtgggcacctcttggtgctagcggtgagccagctatggctggcagtggttgtggtgccccttgctgtctcagtcgcctgcctgaactctgattgtcacatggccacagcgctgcctcttgggcctggagcctcaggtctcctcactgggactgtcactctggagcttcgcagagcaccccgcctttggaaggtgcgggccatgatgatattcaacaccttcaacttgatcttgggtttcatagtggtggtggtcgaggtgatgaagacagccttggggcctgccccaactgcctcctcccagcatgctggcttgctggtgctggaactcagtgctgaggccttcaccctagggggagtgctggtctcagtgcacgccctattcttgctgagccagaggaaaccaggatgctgcaggagccagagtctgcactatcaagagctgcaggagggcttctctgagttggaagaggttcctggtttggagaatggtcccacggtggccagcacaggagcaaatgagagggtgggacagcgggaacagacacgtgctgctctccttccaccctgagagaatgctctccagacattcctgcatcccaccccaccaaactcagaagcttgctgggatccttcgagtccaataggaagtccgggagtgccttcagttttcactcaaagcaggcccttttttcgttccttccctgttaggggaagatacacctggacgagaatatatcctcacctcaccaccctgaaaagctgctttctcccttgcatccatatcctctcttcctgtcacctccccatacagcttcacatttgcctcatcgcacttttcttttctgtccacctttcataatcccatccactccaaatcccggaccctgcacacgccaactccctgaatccaattcaggagtgccccagttcccctttcgatccatctcctttctactgtagcggagactacaagtcccaggatgccccgctagcccgtgaccggctaggaaataaagagccttctctccgcggta

SEQ ID NO: 1310 - DNA, 1236 bp, Homo sapiens
gtctgctctgagctatcaagccccttaggagacctaggacccagctgggtcccatccctttggagtagctgcttcagactagcctaggaagcacctaattcttgtgggcaaaggagccatggaagatagagctggtgagcaagagcaggagagacacagccttcgtctggaaaagctacaacactgggcaaggcacaggcagagtgggcacctcttggtgctagcggtgagccagctatggctggcagtggttgtggtgccccttgctgtctcagtcgcctgcctgaactctgattgtcacatggccacagcgctgcctcttgggcctggagcctcaggtctcctcactgggactgtcactctggagcttcgcagagcaccccgcctttggaaggtgcgggccatgatgatattcaacaccttcaacttgatcttgggtttcatagtggtggtggtcgaggtgatgaagacagccttggggcctgccccaactgcctcctcccagcatgctggcttgctggtgctggaactcagtgctgaggccttcaccctagggggagtgctggtctcagtgcacgccctattcttgctgagccagaggaaaccaggatgctgcaggagccagagtctgcactatcaagagctgcaggagggcttctctgagttggaagaggttcctggtttggagaatggtcccacggtggccagcacaggagcaaatgagagggtgggacagcgggaacagacacgtgctgctctccttccaccctgagagaatgctctccagacattcctgcatcccaccccaccaaactcagaagcttgctgggatccttcgagtccaataggaagtccgggagtgccttcagttttcactcaaagcaggcccttttttcgttccttccctgttaggggaagatacacctggacgagaatatatcctcacctcaccaccctgaaaagctgctttctcccttgcatccatatcctctcttcctgtcacctccccatacagcttcacatttgcctcatcgcacttttcttttctgtccacctttcataatcccatccactccaaatcccggaccctgcacacgccaactccctgaatccaattcaggagtgccccagttcccctttcgatccatctcctttctactgtagcggagactacaagtcccaggatgccccgctagcccgtgaccggctaggaaataaagagccttctctccgcgg

SEQ ID NO: 1311 - DNA, 1284 bp, Homo sapiens
aagatgcattatcatggctgtaaacacaggttctgcacgtgtctaagttcagccccaaacccacatgaagaacttatttccagacagctcctactcttatggtggctccagaccctgccccatgcagaaggcacttctcaagttccaggaccagggcttcagccacagcactcgcaaaaccccacagatacagtgccaatgacagaaattaagattaactgggggcgacacagatttctgtgaatgccagtgctgtcagatgcttcctgatagtactttctagagtaaaagaacttcgggaaaagtaaaagcagcaaatggtaacaccctcatggagatctcagggtgtagaggcaagcactgaaggcccatgatcagccgtgggagccacgggaatcaattgcttccagtacgactggatgcatcggaaagagcctggggcaaggctggaggccacaagaggagctgccaggccacataagcagggaacaaagccgatgatcacacgcccatcagtgagccaacttggtgaagggaaatgcccaagttctcagcacctgcagagcctaagacataacaagcagcatgccctgacgctcaccaaggccaggtgctgtggtgagtgctctacctgtttctgtacagaagagaaatcagaatgccagagacatgaagaaacttctccagggtcatgtaatcaccaaataatgtctgcttcgaccatctctgcattttgtgctacaccaagatttaagcagctgttcaaaggaactgtagaacagatgtcacagatgtaactattcttgaaaggaagtcagatttcatagatggaaagactgcccttttccatttgcctcctccagacccataactttggataggggggttttattgtccgtgaggcttatgcatatgtcagaagaatgtccaagcagaggaatctaagtggcagaccccccaggataggaaagaagaaggacgctcgtgctgacacttccagaacactcttcacgttttgtgacatatgtgcttgtcgagtgatcttaagacagctggatgtccgaaccatgcagtaatagcagagaacctgcggaaggagaagcttcccaggacgttctgagggcttatgccgggtgcaggctttccttcccgcaacatccctgagtccagagaagaaataatcccctgccctgtgggccaagcacttacagcaacagcactttgagtttgctgtgcttagattcacttgtggaacttgttaaaaatataaaattccagacccca

SEQ ID NO: 1312 - DNA, 467 bp, Homo sapiens
attatcatggctgtaaacacaggttctgcacgtgtctaagttcagccccaaacccacatgaagaacttatttccagacagctcctactcttatggtggctccagaccctgccccatgcagaaggcacttctcaagttccaggaccagggcttcagccacagcactcgggtgtagaggcaagcactgaaggcccatgatcagccgtgggagccacgggaatcaattgcttccagtacgactggatgcatcggaaagagcctggggcaaggctggaggccacaagaggagctgccaggccacataagcagggaacaaagccgatgatcacacgcccatcagtgagccaacttggtgaagggaaatgcccaagttctcagcacctgcagagcctaagacataacaagcagcatgccctgacgctcaccaaggccaggtgctgtggtgagtgctctacctgtttctgtaca

SEQ ID NO: 1313 - DNA, 642 bp, Homo sapiens
caagatgctcacgcgaaaaacccactcttcagtgtctgagaccactccgcagctttcggcctcggtgagcgggtgaactaaacccgggaaaccgctgaaagaccccagcttcgactaggcctagtcgtagcggcggccagcgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctggcatgatcaaccagagatggggtcccactattttgcccaggctggtcttgaactgctgggctcaagcaatcctcctgcctcagcctcccaaagtgctgggattacaggtgtgagccactgtgcccggcccggagaacatgatcttaaccatactgtcttccaagtgaaagattctacctttctaagacatctggagtcagacagacctgagttcaagtcgtgccttcctccccactttactgaaccttcagtgagtctttctacctcagaaggctgtgaggatgccatggggtaatgaatgtaaagtgtttaagtgcttggctgacactgagtactaaataaatatcaatttattcttc

SEQ ID NO: 1314 - DNA, 632 bp, Homo sapiens
cccgcaagatgctcacgcgaaaaacccactcttcagtgtctgagaccactccgcagctttcggcctcggtgagcgggtgaactaaacccgggaaaccgctgaaagaccccagcttcgactaggcctagtcgtagcggcggccagcgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctgagatggggtcccactattttgcccaggctggtcttgaactgctgggctcaagcaatcctcctgcctcagcctcccaaagtgctgggattacaggtgtgagccactgtgcccggcccggagaacatgatcttaaccatactgtcttccaagtgaaagattctacctttctaagacatctggagtcagacagacctgagttcaagtcgtgccttcctccccactttactgaaccttcagtgagtctttctacctcagaaggctgtgaggatgccatggggtaatgaatgtaaagtgtttaagtgcttggctgacactgagtactaaataaatatcaatttattcttc

SEQ ID NO: 1315 - DNA, 546 bp, Homo sapiens
cgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctggcatgatcaaccaggtacagaatcagttttttggctgtagatgatttaagagttagggtcaacttgtctttgagatggggtcccactattttgcccaggctggtcttgaactgctgggctcaagcaatcctcctgcctcagcctcccaaagtgctgggattacaggtgtgagccactgtgcccggcccggagaacatgatcttaaccatactgtcttccaagtgaaagattctacctttctaagacatctggagtcagacagacctgagttcaagtcgtgccttcctccccactttactgaaccttcagtgagtctttctacctcagaaggctgtgaggatgccatggggtaatgaatgtaaagtgtttaagtgcttggctgacactgagtactaaataaata

SEQ ID NO: 1316 - DNA, 2686 bp, Homo sapiens
atacccatagttaccactgggagcagggtgggccgtttacactcctcatcctacctcgccatcaccttaggaagcagccattctccttgtctttactgtagaggaggaagcctggacagcctgcagttgaggggacctgcacaagctcacaggactcttcatcaccatgacaccacgctcaccgcaaaataaaaatgatcaaacctgtcatgatgtcagcagcaccggtgttggtctttgtgggaaagaaaaacacaggccagggctgcagcacgattgtgtctgcccagctcttgcagcctggagaacaccgttggattccctcccacacatgctcccaggctgcctgcctgcctcacttacctgctcagggtggggcttgagggtggcccctgggaagagtaagaactggccaagactgagatgtccttccctcatttaaggtaccgccttttcccttttcccgccatcctgggtgcatggatacttgggattagaaactggactggaaatgtaatctttcttcggtttggggctgagaactggggattagtaggattttgagtttatggcacagccttttcttacaccatttcctaaaaagcagttaagattacaccaggcacagtggcttacgcctataatctcagcactttgggaggctgaggcaggtggatcaagaccagcttaaccaacatggtgaaaccccatctctactaaaaatacaaaaattagctgggcgtggtggcacgcatttgtagtcccggctacttgggaggctgaggcaggagaattccttgaacccgggaggcggaggttgcggtgagctgagattgcaccattgcactccagcagcctgggcaacagcaacgaaactccgtctcaaaaaaaaaaaaaaattacagtcatctcccagaaaaatcaagaaggaagaaccttggaggttcaacctatagaagatatgttctcatggaataaaccaaaaataatttttattttctaaaaaatcaagaacagaagtctctcaacatttaagttttacaaacaaatagaatctgagccactgggttaaacatgacaaacgacacacagtaacaaatattgaagacatcataatgccaaagcaacagaagcagcaccagaaatgttgctgaggccaccatttaattaacgcaagttgaacatatggctttggttacatgtggttccaggccagaggcatggaagtcagtgtttgtgggaaagccaggaggaaaagctcctctccccacctccaccttgtcactccaggttctggtgaccccatctcgggacacggcctcccatttcactcctgcaccaaccccactcttgtaacactgcacatgcaagatgtgagcatcttcaaagtacgaatattgccttcttcattttagaatccatgatgtgcttgtggggagaatgaatgaatgctcaaacatgaatggagagagacagagaggaagtgcaggtctaaccaaggaaaccttctttcctagaaaatcgttgatgagcccggaaagagttggctgaacaacggtaacaattcttttattattatttaacttattaagttattagaaaaagtaaaagagtgagtcgaggtttttggattggaagtagggacccactgagttccctccaggattgtggagtttcttttacagccacatgtggataagaaactaagggccacagaccaaatgacaggtcggatggcaaccctggaaaagtcacacagctcagcctgttggaggaagaggagcagtagaacctgtgtggagcctgacagaacccaagatgccattcacgaaccgagaggtctttcaagatcacacacagttctacgacacagacatttcgtcttcttgccactcagtagcggggcccatccctctgtgcctccaaggagaaagaattgtgccatgaaaaatggaaaactcctgagaagctgttccagcgtcaggagagcagcagacaagctggactggggaagattcttcctgcaagacctgcagagtgtatgacacataaccagcacccaagaaatgtctaccgaggaattaatgaatgaggaaatacctctgtacactcaccagacactggctgctggttgtcacggtgctaagagctgtgggaaacatgaagagcaatgagaccaggtccctgctctgaggagacgtgtgccagcgaagtttctctcccacgtgagtgtgctacaagaaaatctgaacccgagaatctgattcagtaggtctgcactttctccactttgccagataattctgattgagaccgtcaaggctgtgactagtggggaggcagtagagtattttctgtgctagactgaggcagccctgaagcactgcgcaagcacatggaaaagagaaacgagattgggccgggcacggtggctcatgcctggaatctttgggaggccacggatcacttgaggacaggggtttgagaccagcttggccaacatggtgaaaccttgtccctactaaaaatacaaaaattagcagggagtggtggtgcacacctgtaatcccagctactctggaggctgaggcaaaagaatcgcttgaacccgggaggtggaggttgcagtgagctgagattggaccactgccctccagcctgggtgatagagtgagactccatctct

SEQ ID NO: 1317 - DNA, 6033 bp, Homo sapiens
aaactttgtctggataaggcgcacgcttggcgacgtcgaaggtccgtccgcagttaaggaagcttttgcagccggacaggtcgcgaagcacacatggggcagggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctccagattcgcacccgcacctgagcccggaagctctgggatatttccgccgggcgctgtcagcattgaaagaggctcccgagactggggaagaacgagatctgatggtgcacaatataatgaaggaagtagagactcaggccctagctttgtccacgaacaggactggcagtgagatgctgcaggaactgttgggattcagtcccttgaaaccgctttgtcgcgtgtgggctgctctgcgctctaacttgcgcactgtggcctgtcaccgatgcggggtccatgtattacaaagtgctttgctacagctccctcgattgctggggagtgctgcagaggaggaggaggaggaggaggaggatggaaaggatggtcccacggagaccctggaggagctggtcctgggactagccgctgaggtgtgtgatgattttcttgtctactgtggagacacacatggcagcttcgtggtcagaactctgcttcaggtgttaggagggactattctggagtctgagagagccaggccccgtggttcccaatcatctgaagcacagaagaccccagctcaggaatgtaagccagctgattttgaagtccctgaaacctttttgaatcgccttcaggacctgagctcctcctttctgaaggacattgcagtgtttatcactgataagatctccagcttctgtcttcaagtggctttacaggttttacaccgcaaacttccccagttttgcgctcatctctgcaatgctgtgattggctacctgagtactcgcggttcctcagtagatggcagtcccctactgctatttctccgagatcagacgagttccagactcctggagcaggtcctgctggtgttggagcccccaagactccagagcctctttgaggagcacttgcaggggcagctgcagaccctggctgcacatcccattgccaacttccctttgcagcgcttactggatgcagtcactacccctgagctgctgtcccctgtgtttgaggagctgagccctgtcttggaagctgtattggcccagggccacccaggggtagtcattgccctggtgggggcctgtcgcagagttggggcctaccaagccaaggtcctacagctcttgttggaggcattccactgtgcagagccctcatcccggcaagtggcctgtgtgcctctctttgccactttgatggcttatgaggtgtactatggactgacggaggaggagggggcagtgcctgcagagcaccaggtggcaatggccgcagccagagccttgggggatgtgacagtccttgggtctctactgctccagcatctgctgcacttctccactcctggtcttgtacttcgaagtctgggtgccttgacgggaccacagcttctgtcccttgcccaaagtcccgctggctctcatgtgctcgatgccatcctgaccagcccctctgtgacgcgcaagctgcgccgccgtgtgctgcagaacctaaagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggccagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttccggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattctgtccctcgaactctccctatctcctgctaacccctgctcccatagaaaagctcactcggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggaatttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagactgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgat

SEQ ID NO: 1318 - DNA, 2679 bp, Homo sapiens
attccatgtttcccatcagctgtcccctgtgtttgaggagctgagccctgtcttggaagctgtattggcccagggccacccaggggtagtcattgccctggtgggggcctgtcgcagagttggggcctaccaagccaaggtcctacagctcttgttggaggcattccactgtgcagagccctcatcccggcaagtggcctgtgtgcctctctttgccactttgatggcttatgaggtgtactatggactgacggaggaggagggggcagtgcctgcagagcaccaggtggcaatggccgcagccagagccttgggggatgtgacagtccttgggtctctactgctccagcatctgctgcacttctccactcctggtcttgtacttcgaagtctgggtgccttgacgggaccacagcttctgtcccttgcccaaagtcccgctggctctcatgtgctcgatgccatcctgaccagcccctctgtgacgcgcaagctgcgccgccgtgtgctgcagaacctaaagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggccagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtg

SEQ ID NO: 1319 - DNA, 1575 bp, Homo sapiens
gggttgctggggttgtgtaactgtgcctagagggcggggttcctgtacattcctacttcaccagataacctgcccccaacaccacttcagcttctgccagacagatggaactctccagcatgaaaatctgcgcagccattccaacaagcagggctctgcctgaggttgtccgaaggatgccgaggaaaaggatatcaggactggaatggctcttacagcaagatccaggtttttcattagtcaatacagtgaaggctggcatgatcatcagcttcccatccaataatatctactcatcagtgtgctgttgtcaatcagagattttcaagtatgagttctccaactcaaagaaaagtagctggatccaggaagaaaggcatttggggaagaacaacgttctttacagtgctcatgatgtgtctccagagaaagttacttcagcactaaaaaaaacaaacaaacaaacaacaacaataaacaactttcctctacagtatcttccagggtctaaactattagacaggttcctaagtttatccagatctctcctatgtctgaattcttggtcatcttccttgcctctggctccacaggtaaagaagaaataataataaaggaacaaaaattatatgtttcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaattatatgtttctgtcgggctgactcattccacttttgaagcacccagtggattaattagtcttattattgcatttactgtcacctacacatttgtttgtgggaaggcactcctcttggcatttgcttagttggaaaaaggaacactaagactatagccactggataatgttcttgaagttcacggcactgtggcagcataaagcttgaacagacctagtttttttattgatggagtgcaactgatgtagcaccacttttctctgacactgtatattagcttttagttatgaactacttccttccagtgcagcagttgttgcctaccattggtaccagtttggcaccattataaagaaacattgtacctcttataggaagaatttggagagttttggtatggtaatcaagatgtgtattgtaataattaactgaattctgtgaacacactgtttctaccttaagtgaaagaaaaagagaacagctgcaattatttatcttcactcatttctcatagatagccaggatttttcagtgtacattctcttgtcctgaaattattttcagttcttgttgattcttatagattataatgagaaaggcacgagcaagaaatttgaaataaagaacac

SEQ ID NO: 1320 - DNA, 2915 bp, Homo sapiens
ctccgtaataagaagcgacgtgtcccactgtcctggctccgtgggtccagtgagattgggcctgggcgctggagctgctgtggctcccgccgcggcggctgccatggaggccatgccagagcccagaactcacgccgggggaggccgagacagccggcggtactcatagatgaggcagcggcggcggcggcggcggcggcagcccgggctctccatgagcaggcggcggcggcgacgggtgcggcggcaccggcagttttcggtccccagggaggatgaagacactgtttgaagagatcaaagcatcaattaaaaataactataaccaagatcgatcattttgtaggcctgttcttccttgggggggtgtttttactatcaaagctggccgcaaagcagtatcctgtacaccactctatgttgaaataagactgaaaaatacctgcaccatagatggattcttgatgttattatatgtcattcttaatgaaaatgaaaacttccctagggaactctctcttcattttggtagagagtttgtagactgttttctttacttaatggacacctacagttttacaactgtgaagctactttggatttgggacaagatggaaaaacagcaatacaaatctgaagtccataaagcttcattaataattgatttgtttgggaatgagcatgataattttacaaaaaatcttgaaaatctcatgtctaccattcaagagagttactgttccaactggcgatgcccaactcgagtgcaggaggatcagcagcgcacaattaatataaatcctccccaagaaattccacatggaaacttgataagactggctgtgaatgagttattctgttccaagattgaactgtgtgaagagcatgggtgtggtggcttaagagaattttcccaacgaattttctgccatggggcacccccttttgttgtcttaaatatgcaacattggaaatctgaagatctggcgtatgtaccctattacttggatttgtctgatcacaagtatttgttggaaggtgccacattatttaacaaagaggaacatcattattctgcagctttccagattggtggacattggatgcactatgatgggctcagaaatgtgaatttaattttgttaaataaacccccagagtttctcctcttgtcatcattggtttatattcgagcaacagagaaataaatatagattgatgctaaaagttgttttccctcctgcccatgctctcccagatgaagggcttttattttgtgtatacttggtatccaagaaaatagttcaactatactagtttcagaagtgtattttcagtgtttaaccccaggtaaatgttttatatagaggatctgtgcaaaaatgtttgtaatttttttatatttcctgagttatttttatatgagcatattttatgttggaataaaatatatcttgtggcctttgtattttttatttatatgtacctcaaagatttttacaattctgtctttgaattcaagaaatactttgtcatctgaattctaaatttttctttttggatattcgagtaaaacctaggtaaaagtattttaagtttatataatttaacagttcaaaatatatctgactgtatttctttgccctacctcactataatccaaagtgcactatttgatctagtatggatttgaatgtacaatttatcgatggcttagtttattagttcgatttgcctagtatccctgcagcaattttttaaaatgtctgagaaatttttcagagcttaaactatttctttataatggcaaattacttttaactacttcctaaagtattataaacctgccagtggattttaagtgatagctaagcttccaagcttaattcacgttattacaaataaattatataactatcttaaatgtttatcttataattaaatgtaatttgaaatgctctaatgtattttgcagataaaacaactataaacaatattaggcaactggatgtttactagtgtcggactagcaatagaaatgcactttaaatatatatttaaggggaaatgcgtgcctggaaatacttcttttcctagtgaagttttatattgacacagagaaaagaatacttaaaattttgagtgatgtctactggcttccttgtaagtagtgattgatagcatgcggctttgacttgcaatacaaatcattacgattttatagttatcagaacattacgtttctttataaagaccctaaggtcactcttctttttgcaacttaagggaaaaaatattctcaagggaaaatactttttgaaatttatcaccattttagtgtttacatttcaataaatagttcacttcaggtttgggattgagattagttgcaatatatttagaagctcctacatgacagcacagatcactgccatctgctgaactgctaaagtgcttggtgccatgttgagaaaacttacccaagaatggataaatatgggtgaaacattactgagaatgcctcacgttagcaaatactatgaaaattcttgtttatatatcaaactgatttattttacaaaaaaaaaaaattcaccccaagatttatttagtttcccaagtgtatctgattaggatttaatttagagtaaacttttctggggacacctgattgcatgaactgaagtatacaataacacaaatattacagtaaacataaatggtgtcattaacaaaattattcctaatgcagatttattctttcaggaaatgcactttatttggaatactagtttatcatgaaacaatgacttacctacctcacagggttgttgtgaggattaagatgtttgttaaaatcttgactaccttgaacatgctaataaaaaaacatttttctacctcttttatttgca

SEQ ID NO: 1321 - DNA, 2543 bp, Homo sapiens
gtggcaaccggcaatccttggctctggcttaggaggcgctcaagtagagcggcaaaatggccctgagcccctggaccccagggctgggcgctggcgagaagctggtgcaggcggctgccgtctccactggcccctccctggagttatgcaccttaccctccaccctgggctcctcggtcgcggtcgaggcgctggagcagctgtttgttgtggaacaatcactgcaaagtgactattttaaatgtaatgaagaagctaagatctttcttaaggacattgctgtagctgttaagaaattggaagaaatgagaaaagccacaatcgatcttttggagattgaaagcatggaactcaacaaactatactatctattggaaactcttcccaatagcattaagagggaattggaagaatgtgtccgagacgctcgcagattaaatctttttgagataaatacaataaaaatgagaattacaaggacagagaatgaaatagagcttctgaagaagaaaataactgacctgacaaaatataatgaagctctgggggagaagcaggaagagctagcaaggaagcatgcaaggtttgtcctgtcactcaaccaaactatggagaaaaaagccaccaccactgtttacataaatgagacttataccaaaataaacttgaagagagaagacatagcattgcaaaaaaaatgtattcaagaggcagaggagctaatggaaaaagaaagggcagaatatctaataagaaaacaagagttgactgcacagattaatgaatttgaaaatacccgtgaagtaaagagaatggagacttatcaaaagaagaaagaattggataaattacaaactaaaatgtcaaaaataaaagaaacagttactgtttccgcagcggttcttagtgatcacaatttagagatagcacgactacacgaatcaataaggtattgggaacaagaggtcagtgagctaaagaaagaccttgcaattctggaggcgaaactgtgttttttcacagataacaaagaaaaactagatgatatatctaatgatgaaaaaaatgaattcctgaacaagataaaacagctggttgaaacactgcatgctgctcgtatggaatacaaagacctacgagagaaaatgaaaactcttgccagacaatataagattgttttaagtgaggaagaaaaagcttttttgcaaaaacaaaagattcatgatgaaaatcagaaacagctgacatttatttctcagaaagaatactttctgtcacaaaagagagtagacatcaaaaatatggaagaaggactcatcacactccaggaacttcaacaagcaacaaaaacagtgtatcagcaacaaatcaaaatcctgagtgctaacctggaaagagaaagtcagagatgtgttataactcagtggaaaatggcttgcttgagaaaaaagcatgcacgttggacagccaagataaaagctgaaatacaagctattacagaaaaaattcagaatgcagaagttagacgaattgaattacttaacgagaccagtttcagacaacaggagatcagtggatttgtggcacagattgaaaaacttacaacagaattaaaagaagaggagaaagcatttgttaacaaagaaaaaatgttaatgaaagagttaagcaagtatgaggaaatatttgttaaggaaacacaaattaacaaagaaaaggaagaagaactagttgagtatcttccacaacttcaggtggcagaacaagagtataaagagaaaagaagaaagttagaagagctcagtaatattattacagcacaaagacaggaggaagatttactgaacaatcacatttttctgtttacaagggacttttcaagatacattagcaacatggaagatgtaaaacaagaattacaacaattacgagatcaagaaagcaaaaaaaacaaagatcattttgaaactctaaagaacttagaaaatggattctatataaatgaccaaaaagcagatcttctgctcctggaaaataaaaaattaaaagaatatattttatacttgaagaataacatagagaaatacagagaaggacaagaagccctcatgcacacctcaagcgacttgtctcggcaactaatagctcaggaggcacaatataaggatttgtgggctgaatttcagaccacagttaagatcttggtggacaatggtgaagagaccttgcaagacataaacaatctaacagacaagctgcgtgaaagagatgaaaaaatgcagcatgtcagtacatggctacgagggagtcttgaagggctgcgtttgcttgtggaacaggaatcaccaatggaccttcttagtaagcaacagcttagagctttgctggtaacatcaaaagaagaaaaaacgtgtcaactaagtgacttagttatccccaattatgccacaaacattcaattgaacattgatacttatttggggttgaatactcttgtagtgttatccaattctgcctttcacctaagagaattttctagataa

SEQ ID NO: 1322 - DNA, 2594 bp, Homo sapiens
gtggcaaccggcaatccttggctctggcttaggaggcgctcaagtagagcggcaaaatggccctgagcccctggaccccagggctgggcgctggcgagaagctggtgcaggcggctgccgtctccactggcccctccctggagttatgcaccttaccctccaccctgggctcctcggtcgcggtcgaggcgctggagcagctgtttgttgtggaacaatcactgcaaagtgactattttaaatgtaatgaagaagctaagatctttcttaaggacattgctgtagctgttaagaaattggaagaaatgagaaaagccacaatcgatcttttggagattgaaagcatggaactcaacaaactatactatctattggaaactcttcccaatagcattaagagggaattggaagaatgtgtccgagacgctcgcagattaaatctttttgagataaatacaataaaaatgagaattacaaggacagagaatgaaatagagcttctgaagaagaaaataactgacctgacaaaatataatgaagctctgggggagaagcaggaagagctagcaaggaagcatgcaaggtttgtcctgtcactcaaccaaactatggagaaaaaagccaccaccactgtttacataaatgagacttataccaaaataaacttgaagagagaagacatagcattgcaaaaaaaatgtattcaagaggcagaggagctaatggaaaaagaaagggcagaatatctaataagaaaacaagagttgactgcacagattaatgaatttgaaaatacccgtgaagtaaagagaatggagacttatcaaaagaagaaagaattggataaattacaaactaaaatgtcaaaaataaaagaaacagttactgtttccgcagcggttcttagtgatcacaatttagagatagcacgactacacgaatcaataaggtattgggaacaagaggtcagtgagctaaagaaagaccttgcaattctggaggcgaaactgtgttttttcacagataacaaagaaaaactagatgatatatctaatgatgaaaaaaatgaattcctgaacaagataaaacagctggttgaaacactgcatgctgctcgtatggaatacaaagacctacgagagaaaatgaaaactcttgccagacaatataagattgttttaagtgaggaagaaaaagcttttttgcaaaaacaaaagattcatgatgaaaatcagaaacagctgacatttatttctcagaaagaatactttctgtcacaaaagagagtagacatcaaaaatatggaagaaggactcatcacactccaggaacttcaacaagcaacaaaaacagtgtatcagcaacaaatcaaaatcctgagtgctaacctggaaagagaaagtcagagatgtgttataactcagtggaaaatggcttgcttgagaaaaaagcatgcacgttggacagccaagataaaagctgaaatacaagctattacagaaaaaattcagaatgcagaagttagacgaattgaattacttaacgagaccagtttcagacaacaggagatcagtggatttgtggcacagattgaaaaacttacaacagaattaaaagaagaggagaaagcatttgttaacaaagaaaaaatgttaatgaaagagttaagcaagtatgaggaaatatttgttaaggaaacacaaattaacaaagaaaaggaagaagaactagttgagtatcttccacaacttcaggtggcagaacaagagtataaagagaaaagaagaaagttagaagagctcagtaatattattacagcacaaagacaggaggaagatttactgaacaatcacatttttctgtttacaagggacttttcaagatacattagcaacatggaagatgtaaaacaagaattacaacaattacgagatcaagaaagcaaaaaaaacaaagatcattttgaaactctaaagaacttagaaaatggattctatataaatgaccaaaaagcagatcttctgctcctggaaaataaaaaattaaaagaatatattttatacttgaagaataacatagagaaatacagagaaggacaagaagccctcatgcacacctcaagcgacttgtctcggcaactaatagctcaggaggcacaatataaggatttgtgggctgaatttcagaccacagttaagatcttggtggacaatggtgaagagaccttgcaagacataaacaatctaacagacaagctgcgtgaaagagatgaaaaaatgcagcatgtcagtacatggctacgagggagtcttgaagggctgcgtttgcttgtggaacaggaatcaccaatggaccttcttaagaagaagaaacacattcgtacaagggttcatttcccagtggttaaatgtactgagaaaaatacattaacaaagtaactcaaggatacaactgctgtgaattcaaaagacagactactacaggaaaagtgagtgcacttactttcatattttgcagctgttaatagaagtcttaaacatttaaaatttaactaattcacacaacctccaccaagtatcagtaaataaacttct

SEQ ID NO: 1323 - DNA, 2813 bp, Homo sapiens
gctggtaccaggggcgtgggggcggggctgagcgagtccagcccagggctccggggaccgtttgtagttaggatccgctgtggcgtcctgagtggagtttgggaccccagggagggagggtgtgggcgttcgggtccagaggagctgtttagtatccaagatgaatgacagcctgtttgtcagtttggacagacttttgctagaatttgtcttccagtatgagcaagacataagtactaaagaagagatgattcaaagaattaataaatgctgtgaagatattaaggaaaacaaagtaactatttgtaggatacacgaaactataaatgcaacagatgaggaaattgatcattactgtaaacatagtgaggagattaaagacaactgtagaaactggaagccaacatgtgatgtttttcgtaaacatgaagattatatgcaggaccaatttactgtttatcaaggaactgttgaaaaagacaaagaaatgtatcatgattatatatgtcagtataaagaagttttgaagcagtaccaactaaaatactcagaaacacccttttcacgtgaatattatgagaagaaaagagaacatgaagaaattcaaagcagagtgttggcatgtactgaacaattaaaaatgaatgaaacaatttttatgaaatttcgagtgcctgctccctttccatcacttactaaatggactttaaacattgttaatttgagatgtgaaacacaagatattcttaaacatgccagcaatcttaccaaaagttcatccgaattgaagaaagaagtagatgaaatggaaatagaaattaattatttaaaccagcagatatctaggcataatgaaactaaggctctttcagaaactctggaagaaaagaacaaaaatacagaaaacagaaaagaactgaaagaaagaatttttggaaaagatgagcatgtacttacattgaataaaactcaaagcagtcaattatttcttccttatgaatctcagaaattagtaagaccaataaagatgcattcttcagaaccaagagttgcagatataaaagaagaaagttctgcgaagcagtcaaagcttgccaatattgactttagacaaaaagaaaatgatacacagatatttaatgactctgctgtggataaccattcaaaatgttcacatattacgactatcacaagttcacaaaagtttatgcaagtcagattgttaaccccacagaaacaatcaaattccaatcagtggtcggaaaaaggggataaagatgctgagtatggagataaagggacagtaagacaagtaagagaatcaaaatgtacttcacaagctatatatactgaacattttgggaagtcagtagaaaatgatagtgatgaagtagaagagagagctgagaattttccacgaacgtctgaaattcctatatttttaggaactcccaaagctgtgaaagcacctgagtcattggagaaaataaaattccctaaaacccccccgttcgaaattaacagaaatagaaatgcagtacctgaagttcaaacagaaaaggaatcccctggactttcttttcttatgagttatacttctagatcacctggattgaatttatttgattcttctgtatttgatacagaaatctcatcagatcagtttaatgaacattattctgcaagaaatctaaatcctctgtcatcagagcaagagattggaaacttacttgagaagccagaaggagaagatggctttacattttcttttccatcagacacttcaactcatacatttggagctggaaaagatgattttagttttccattttcatttggacagggtcaaaattcaataccttcttcttctttaaaaggtttttcatcttcctcacaaaatacaacacagtttacttttttttgagctagtcattaattccttaaattattttactgttctgtgttcatgagggcataaatttacattattgcttaaaacatgaagactgctttcttttattgattaaagcagtaatgtttacattatttgattatatttattgaaatattgaaatactgaatattttgggttttgtgtgtgctattaactaatcattatttattttggttttgattttgcgagccgtggtcaggtagaacttttattaatcttaatagaatttgatgcttttttcattactctttatttaaatattaagcctgcttctccttggaacctaaggtttttttctggaagtattgttggtactttgataagaacaagaactgcagtagtaactccagagttagtgctgaagcgtactttagctactaaaaatttctattaaaattattgggtttcacttctgcttcactatgtagtatacagagtggtactgtaataataatttcaaataatttatgttaataacaaaatctgtgttattttcttctaatataacacatggtacaattctaattttatgagttatgctaatgctttcaatggctaaaaattaaatgtaaagggcaagagtaatttctgaaaattggattgttgtatcagtggtgatcctgttaatattcttttttgcttaaatattttttgaagaacatttacaattttgtctccttcaataacaaaaatttcttctttatgttttgtgttcagtatttgtcaattaattatatagcttaagtgaagatatttaagatttgatgaacttctgtaaacattttgctcaatatcattgtattttgtgctttgtaaattagctgtactgagttaccaagtaataaagggtttgactcca

SEQ ID NO: 1324 - DNA, 558 bp, Homo sapiens
attctcccacctaggtttaaattgaaccccgtctcggtcccccggttttgagaggtttctctcctcgagccgctgagtcacgcagcccaacagtaggagtggctcgaggcctacacgtccgcgagttcgcggggcgctggatggaaaagatttgaaacgccacctgtatcacatactaaatttatatacatagaaattattctggatcttctattctgtttcatcgatatgtgtatttattcctattgtttcacaactgcagttgaagtacattttaatatctgtatccaagatgaatgacagcctgtttgtcagtttggacagacttttgctagaatttgtcttccagtatgagcaagacataagtactaaagaagagatgattcaaagaattaataaatgctgtgaagatattaaggaaaacaaagtaactatttgtaggatacacgaaactataaatgcaacagatgaggaaattgatcattactgtaaacatagtgaggagattaaagacaactgtagaaactggaagccaacatgtgatgtttttcgtaaaca

SEQ ID NO: 1325 - DNA, 3106 bp, Homo sapiens
gcgcgccgtcagcggcgcgggtggggcattgccagctcggcgtcccggttcccttggagacagagctggccagggcggccgcggctgggcaactacgacagcggagcccctggggaagccaagatgccgtcgaagggaaaggacaaaaagaaaggcaagagcaaaggcaaagacacgaagaagttaataaaaacagatgaatctgtggtggacagagccaaggccaatgcctccctttgggaggccaggttggaagtcacagaactctctaggattaagtatcgtgatacttcacggatactggcaaaaagtaatgaggacttaaagaaaaagcaatgtaaaatggagaaagacataatgtcagtattaagttacctgaagaagcaggatcaggagaaagataatatgattgaaaaactgaaacagcaattaaatgaaacaaaggaaaaagcccaagaggagaaggataaattggaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaagcaccgactagaacaagaggctgaaaagaagataataatgctagcagagagagcccaccatgaggctattgtgcaattgaacgatgctggaagaaatgtttttaaagagaatgattatcttcagaaagctctggcatatcacctgaaggaaactgacgctctacaaaaaaactcccagaagttgcaagagagtcatactttacttttacatcaaaaggagatcaatgatctgttggttaaggaaaagattatgcaacttgtccagcagagatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttggggatgaaagtaagcttcaagataaaatcttcatcacccagcaaattgcaatatcagactcttctggtgaagtggtgctacccactattccaaaagaacctcaggagtctgacacaggaaccttctgagaagcactgattatgacctcacagatgctgctggcagtcccttccttgcagaatccttgctcctgaatatctttaagaaaatttcttaaaggaaaagacaaaaaatttaactcaaaagttacctgtttgccatagaaattggtgtctcccctgaaggaggatcgagagccggtgaatgagaacattggcaaaggcactggaatggggacattcactcccacctaaaacagaacaaatccgtgtcatatcctaaggacaaaggaactctccatttagaaacacaaaggcatcagagaccagttttaaatacccaccttctaccctatcctctaccccatgaactttcattcctgaggaagaaatggggcaatgtgggaggtcatgggggcaatcttaaaccaatgactcaccattatttactgtttcctcttaggaaatagtaaatggatataagaatctcttaaaaattctgttcacgaacctgtccaacatccaccaagtgggcatatttccgagcagtggctccattggtggtgaagatggcagttccatttccatatgggttgttatttacaatctggatggcttcatccaatgtttctgtctccagaaccacaagaactggaccaaaaatctcctctttgtaacaggtcatatttggctgccaggagtgatgcatccagaaaagaagtcagctttttggattctgagtattttatgcttatttggtactttcacttactacacatcatttacgtggacaactttcatattactaatctcttttcatttcaaatcacctatttaaaaaaaaagtcctctctcaagtgtattccgtcttccaagttaccaatcatataaacaacttggaattcctatcaacaataaccacacttcctttaagggactgtatctttagttcatgacccatcatcagctgcctttttaatacctgaacgactagtttcatccaattgttatcaaaaagttacatgaaaatttattttttataaatccaatctatagtaaatataccaggataatttttctctttacagaaaccccatgctgttttctgtaacataaataatccattcttattcactcctttgcctcccaaatatgtctgtatgtttatattttgatatcaggtcgcagacactcaaaacatccttcaccatgcaattaatgtttgttgctgataaacggatttttctgtatggttctgtggcaagagatttcataatttctactgcacttacattcaacacttgatgattcactattatagtaaggatatatgaatttcaaaaaatgcctcataacctcaatttttaagtcatgttagctgagagactttcaaagttttgataaataaaaattgacaagtcaa

SEQ ID NO: 1326 - DNA, 1715 bp, Homo sapiens
aacataggattttttgggttcacacatacagctcatagcagtccctttttgatggatagttgggttgtttccagtctttttctattacaatgaatgtgccagtaaagagcttcatgaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaaggcaattgaacgatgctggaagaaatgtttttaaagagaatgattatcttcagaaagctctggcatatcacctgaaggaaactgacgctctacaaaaaaactcccagaagttgcaagagagtcatactttacttttacatcaaaagagttggtccctgagtcacttaggaatacatttagcggtgagtaacagtcctgacatcagtggcatcaccacacaagggtttattctttcacctaaaggaggcctggaggagatcaatgatctgttggttaaggaaaagattatgcaacttgtccagcagagatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttggggatgaaagtaagcttcaagataaaatcttcatcacccagcaaattgcaatatcagactcttctggtgaagtggtgctacccactattccaaaagaacctcaggagtctgacacaagcacacagaaaccatcagatgagaacttctcaacttcctactagcaaacctacaaaactgaactcaacctaatggagaaggtagccagcaagctccatgcaggaaaagtgaccgagacagtggtgcacgatcaatatatgtggactggatgaagaggtccccactcagccatcatcactttctctaggaagtctcaacctcaggtctatggtcactagattgttgtgtccccagcccctagcacaattcctggaagagagtcacttcagaagtttctccaaatgaatcagaaaatacatagtgtctgtttctgaaataaaagtacatggaaagag

SEQ ID NO: 1327 - DNA, 2136 bp, Homo sapiens
tttatttatttctttggcttatctataatttcggaatttttcttttacaattaacatgaaccatttctgaaacaagaaaaaaaatataaaagaagaaactaagaaggaaataacctgttttaattgagacacagagggcaaataccacatttaatggtaaaaacagaacggaaaggtatttttcattggtgagagaaatattggtttgtcttcttgtctgtttttttctcatcctctctcacagataggaatgtggaagatgaggagagagggaaggaagaaaacaaggaaaggaaggtaacagcagaattgttacatgatgtggacagccgccaaactcaatagttctgagataaataactgtgcaaggtttagaggcaatacccaatgtttgaacctcagagttacacaatccacccaatacagggataagctatgtggcagagaatctcatctgagaaagataaaggatatgtctcaggaacgcttaatcaacaggtttgtccttcacatttatttatcacctacttggtgccaagcatttacaatatcctagggagacaaacagaaaatgttatctttttttacatggcattggattcacatggcatgtcattttcatattgcgtagagtggtgagtgattaggcctgtcaaagagaatcaggttcaggttctgcctccgatgccaactatgtggaggatgctacaccaagcactgaagctcagaaggagaacagttttggcagggcaagaaataagctatgttctacctgttatgtttgtggtaagtgaggaagattcaaacagagatgtctttttggtagctggatataggcatttggagtttggagagaggatagcaatttggggatcctcaatgcagcatgtagagaggaggagatggcccctggacagcatacagaaaagaatgggccaaagtttcacggggtgggcagaagaagctgccccgggaatgaagacgaagaaggaatatgcagagattggggtaaaaccaagacagaatgcttgtgaaatgtgcccaggaatgatcctctccactacttaaaatttgcttaaaatgagctgtttcagtacatccctgtgcagctgtgagcagctgtcctggttaataacatattcccatgtcccaaaggacacaaaccttggaagatgtgtttcccaataacttttcaaccttttactgagcagaacacatgaattttgcccttcctcatttggaaccatgtggaaaggggaaccacgaatggggatctgcttttggtttggattggggcttgctatggtttggataatgggattttttgtccccatcaaatctcatgttgaaatttgctccccactgtggtggtgtcagaaggtggggcctaggggaaggtgtttgagttataggcgtagaaccctcatgaatgacttcgtgctgggctgctgttctcactctggcgagatgggattaggttggtttattattatgtaaagccaggatgccctttgggtatggtgtctcttcacacgtactcacttctcctttgaccttctctgacatgttgatgccggtgccatgcttcttgtacacctgcagaactgtgagctaaataaccctcttttctttataaatcctcttttctttatacccagtgtctggtactcctttacagcaacacaaaatggactaagacaggactgaaactcaagcaatggatgtggtaataggaaagagaaaggtacagtgcattcagcagagtcacagttgtaaagtaatgccaacaaaaaaaaccatctacaacgtgaaattcgtctctggaggtcagttgatgacctgaggttcactgaggataaactaaaaaccatacggcttagagtctatcacagcctctgctaaggtaagtgtgagtgacgcagctctattcccaaagacctggcccatgggaagtagtgtacaggcaccagaccccaggtcaagaggtctggctctgccactaaaagctggttgagcctagaaaggcctctttacccctgagcttcagtttcctcatttacaaagcagaaatagatatgtctgccttatgtttttcacaggccttttacaaatataacatgcaggatgcagagtgct

SEQ ID NO: 1328 - DNA, 2370 bp, Homo sapiens
acggggcggcgcaggcaggagggaacggctggttgcaggtttctctcgccctggtcccgcgcggccccgccgaggcggcgaccaaggtgggtgcggggactctcgggagccgtgggccaggcgcttagccggccacctcgggccctgtccaggcccaggcgttccagggctgctctgcgggccgcgtgcgagagggactctcgggaggccccggggcgccgcacccactccttcccacttgggactcccgcgggcgcccggctctcgctcctctggccagcgtgggcctcccaggccccctcgcggctctctccagagcaggagccccaccttgggccgcccctctcacacctgccgtgggtctggtacgcgcctctgtgtcggactccgcgcccgcctgcgtgggaggaagccaggactcccgggcgaccgggccattcctgtggtttgtgtcagttccacagcagcacgtgggcactttccaccgtcagccactgggcagcccggggcactcctgcagcgtcccctggccctctccagggcaggggaaggttgggcagtcctgggcggccagcaccccggcgtgcatgtctcctgagcagctgcccatcgggcctctgctggcctgggggctccaagatgcaaggccggcgggagctggggggagagcctttgagtgacctccaggaggaagcagccagcgcttccctccgagtggcacctgagaggctgagtgatgacagtttggaatggagacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctgg

SEQ ID NO: 1329 - DNA, 1947 bp, Homo sapiens
gggagagcgctgaacaaggccgcagagctgctccgccatctcccccacgcctcctgccaagttctgtggcgccgcggttccccacctcctgctcccatccccctggctcccgccgccctgtagctcggcagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattgggtacagacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctgggcagtggtggccagtgtagggctggccaggtgctggaggacatgcataccccagcactggtgagtggcaggaccacggggaggtggcacaggcctccctggagcgggattatctcggccccgccccccttcatttgggctcccgctgtgggcctggccctgggctgtgagcacagctgcccccacctccggccaaggctgtgcctggtgggtgcgccggatgggagcccggggctctgctccttcccgggaggtggtgctccgggtggggaggcacag

SEQ ID NO: 1330 - DNA, 1327 bp, Homo sapiens
atgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgt

SEQ ID NO: 1331 - DNA, 1553 bp, Homo sapiens
tgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataa

SEQ ID NO: 1332 - DNA, 1630 bp, Homo sapiens
ttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgt

SEQ ID NO: 1333 - DNA, 1845 bp, Homo sapiens
ccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcctgcagcctgctctccccttttagggcgctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcct

SEQ ID NO: 1334 - DNA, 1476 bp, Homo sapiens
gccgggagggccgcctggaagaggaggtcgggggcgaaggaggccgagaagaaagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtg

SEQ ID NO: 1335 - DNA, 751 bp, Homo sapiens
cacgaaggcgggaccctgccgacgcagtgattggatgcatgtccggccagcgcggtgattgggtacaggtctcgggagcgcggtgattggacctccgcgctctggcagctcctcttccgtgtgctctcgccactccctgcgggcaacgccttggcatcgctcgccctggggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgag

SEQ ID NO: 1336 - DNA, 543 bp, Homo sapiens
gctgaacaaggccgcagagctgctccgccatctcccccacgcctcctgccaagttctgtggcgccgcggttccccacctcctgctcccatccccctggctcccgccgccctgtagctcggcaggtgcagtaggcgctccgaggaggaggccccttagcttcaagaaacccgcgtgggcgggccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgagga

SEQ ID NO: 1337 - DNA, 966 bp, Homo sapiens
gtccagggaggactgagtttccctctcccgccgtcctcgcagccccgggaggtgcaggggcatcgcgggaacagccccggtgacacgctgcccggggtcttcacgaatgcccggaggcgccgctggccagaagccagcccgaccttccatccccgcagacagccccacgttcctcccggcccgcgtctttcggggccgcccgtgcaggcgggcccggctcagcggcgcccgggcagcagctgcttccatgcgccggcttcctccggggctgctccgtggcggcggcagagggaagcgctgccgcgggcgggcgaggatcgggagcgcctgaggaggctgccgcgggctccggctgcgcgttcggggcgggggagctgcccgggacttcgcgccaggggccaggggccggccgcgctggggtctgcgctgtgcggcgcggcgggctctgggcgcctcctggcggcccagcctggaaggcggcgcgatggggcgaggctcgtccgctccgactgcccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcc

SEQ ID NO: 1338 - DNA, 1107 bp, Homo sapiens
cgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctga

SEQ ID NO: 1339 - DNA, 522 bp, Homo sapiens
atgattgggctcaggttccagccggagcggtaactgggcgcaggtcccagccgccgcactaaacccggcccgtgcggtgattggacgcaggccccgggccgcggcggaggcgggcgatccgaaagagacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgcca

SEQ ID NO: 1340 - DNA, 3549 bp, Homo sapiens
aaaccgtgggcacccgaccgacgcacacgcgcagccccacgacagtatcagtatttaatttccactagagacagaactaagcctaaccatcaccaggctcaagccgcctaccccaaaaccgagaacggaactgcccggtccccccgaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttg

SEQ ID NO: 1341 - DNA, 484 bp, Homo sapiens
ggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacaggcccttcatgtacattccagggccgttctcttctgaacaatatcccttcccaggatggcttggttag

SEQ ID NO: 1342 - DNA, 1631 bp, Homo sapiens
gcctggggccgggtcgtcatggcgacgcgccacgctaacgcatggtgtcggagggaggcccacttgctgaacagcagggagcgatggcgcagaacgtgtatggtccgggagtccggataggcaactggaatgaggatgtctacctggaggaggagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgccactggtcaagtccttagatatgggcaggacttttgcctggggataacaggaggatttgacaacaaaatgttgtatttgtcaagtgaccacaggaccctcctgaaatcgtctaagaggtcttggctccaggaagtgtacctaacagatgaggtctcccatgtgaactgctggcaggctgccttccctgacccccagttacgcctggaatatgaaggcttccccgtcccggcaaatgctaaaattctcatcaatcactgtcacacaaatcggggactggcagcccaccggcatcttttcttaagcacctattttggaaaggaggctgaggttgtagctcacacatacctggattcacatagagttgagaaaccaaggaaccactggatgttggttactgggaatcccagggatgcctcgtcctccatgttggatctgcccaaaccacccacagaggacactcgagccatggagcaggccatgggccttgacacgcagtaacacgccaggcacgtgcatgttttccctggtcccgctctcatcaaatgtagctttaaaagaaattaacaaccttggtcatgcctcaagctatttttgaatcagatgtgggactctctgggcactatattaaaataaagattacattaagattattgaatttgtggtgggagtctagggctgaagaaaaacagctctggagaataattagtatttgaaagtgacaaacaatagccttttgttgataaacaaattctgaagaactcagcttcctctacttatatccttcattgtctacaaggacagtgcgttactttttaaagttatgtctatgtaataaagctgttggacctatactgaatttttggtaccacagtttccctcttgaatgtactaaaacacaaaaaactgacagctctgagctgtggccttaccttggaattaaacatttccacctttgtaaaacatcctatttttgtttctacctttggctttccaggtcaggacctctacctgatcagtaacctattattttgtaatgatttttaagctgcagaatctctaccttgtctttgaaactggcacattagttgtggcacccatgtgattagatagttcctgacaaaataaatgtatgtccttcca

SEQ ID NO: 1343 - DNA, 1540 bp, Homo sapiens
ggcccacttgctgaacagcagggagcgatggcgcagaacgtgtatggtccgggagtccggataggcaactggaatgaggatgtctacctggaggaggagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgccactggtcaagtccttagatatgggcaggacttttgcctggggataacaggaggatttgacaacaaaatgttgtatttgtcaagtgaccacaggaccctcctgaaatcgtctaagaggtcttggctccaggaagtgtacctaacagatgaggtctcccatgtgaactgctggaatatgaaggcttccccgtcccggcaaatgctaaaattctcatcaatcactgtcacacaaatcggggactggcagcccaccggcatcttttcttaagcacctattttggaaaggaggctgaggttgtagctcacacatacctggattcacatagagttgagaaaccaaggaaccactggatgttggttactgggaatcccagggatgcctcgtcctccatgttggatctgcccaaaccacccacagaggacactcgagccatggagcaggccatgggccttgacacgcagtaacacgccaggcacgtgcatgttttccctggtcccgctctcatcaaatgtagctttaaaagaaattaacaaccttggtcatgcctcaagctatttttgaatcagatgtgggactctctgggcactatattaaaataaagattacattaagattattgaatttgtggtgggagtctagggctgaagaaaaacagctctggagaataattagtatttgaaagtgacaaacaatagccttttgttgataaacaaattctgaagaactcagcttcctctacttatatccttcattgtctacaaggacagtgcgttactttttaaagttatgtctatgtaataaagctgttggacctatactgaatttttggtaccacagtttccctcttgaatgtactaaaacacaaaaaactgacagctctgagctgtggccttaccttggaattaaacatttccacctttgtaaaacatcctatttttgtttctacctttggctttccaggtcaggacctctacctgatcagtaacctattattttgtaatgatttttaagctgcagaatctctaccttgtctttgaaactggcacattagttgtggcacccatgtgattagatagttcctgacaaaataaatgtatgtccttcc

SEQ ID NO: 1344 - DNA, 1749 bp, Homo sapiens
attggaaccactggaggagctttaaaacctcctgaaacctaggtctggccttcagggaatctgattccttggtctggggtatggcccgggcatctcctgaagctcaccaggtcacacagaggtgtagccccagctgggaaccactgacccagactcagttcctgaatttctgtgaccgcttccatggcagcccctctcaggcccctggtgtgaggtctttcttttgcttctggcttctgagagtttcctttcctgattccaggctgggctcggttttgtctggtgggtttttttgccactgccgttgtgttagtggcatccaggtctccggattactgcatgcttgcagtgggaggaaaggcctgtctaccatgttctctgcctccccttcatgttctgtgaggagaggggccttgtctggcatgttcaccgaggcattcctgaccactagaactgtgcttggcacagagtaggcacttaataaactcctgctgcatgaacaaaagaacaagtgtggatgcttcaaaggaagacttgcacccggctgacccccagagtggggaaggggtcccacctaataggaagaacaccaagacttccccaagaggagaaggaacggctccccctttctcggcgaggccatgtgtctggaccctgtgtgagatgctttctatactagcccttgttggggtgttgcacccattttacagatcaaacaaccaagtttatcagaaattaaagactcatttaagatgccaaagctcacgagtggatggtttgatgctgaagccaacattgttaacaccatctcagctcaaaagccctgaaggccacttaattctaccaaccttcaaccatcttgtcataagacacatcctcgacccaaagcagatattctgtgtagctgatgtgtgtacagattgcaaattcaattgcggaagcatagagaggcaccagaagaggcatcttatgagagtcagccaggactgggaacatttaataagatacagaaaccagatttgcttgagctgaatgctggatcgccatggcaaccttcctttggaggttatccaagtcaggtagtgacagcaaagctgagttaaaggtcacccctgctgagaaagatgggcattgataaaggattttaacaagacccagaggagctggtatttggaagctacctacagaggatcgacgaggccctaggaatgggtggcaaacaacatcaggaagaggggggcatcctgcaggggctcccaccagagccccgacctcgcccttcagatcgggagctccagccttcaccagaagctgagattggagctgttcgtaattgttcaatggaagggggaacaaccattttaaccaggcatccagatgggaaagaaatacacttatgccactctacacccaagacacgcattcctgaaaagttctgaacaagccaaatgcttgcaaatggaacgggcttgaccttctttatcactccagaaatgctttatttaatcttttttctattggagcatcactttaaaacctcaaagttgagaaggcttttctttgcatgatgctgaagccagaagccttcaaggaaacaacataaatataaatatctctgtggccagtctctacaaaaatacataaaaatgaattttaagcataataaaatgtgaaaaattgcccaactttcctcacaaatgagtaaaagccaatttaaatgataagaaatgaataaatgcatattaaagc

SEQ ID NO: 1345 - DNA, 2008 bp, Homo sapiens
gcaacaggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcatttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgatgaaagagtttttaaaatctggaagactcattttctctcagaagcctccattgctcttttgcatgactccttttggtggtggtttctccataaatttaggcctgacagagaaaaccaagattgcttattcgatagaatttcagaaagttatgtgacacttttcatgagcatacctctaagtcgaaaggatgcattttttcagatatatcctgattgtttggcacaagccatatatgcaacgttccatgaagcatttccagaatcgagttacctctttaatgatgaatttaaagaagatctagggaataacatttttctttggtgttcaggtttaaaacctcaaaaaggcttttggatccactggaaactgaaagaactctccacaaccaccattcatggtagcaaaaaagcacctgcaaaatcagtaaaggaaagaattgcagacagtcaagaacatatatcaactagtatcgacttcaatattataaagattctgaacaacccaagagcatatacgttgcccatatccaaggaagaatcaagattatcaagactagcaacaaagtcgcactatagtagtactggtccagagtttaatcgtgttctcttcaattttggaggtcagagtccattgattttatattatcttaagatgcatgagctggctggtatttccaaagcacctaagaaaaccaagattaaactcactaagatattccaggaaccactacctgctccaacataccgtgatgttataaaggaggcaaaaagacaatttgcaaggaaccaaaaggattttaggatactccaagcaaaggctaccaagaaacctcatgaagtgaaacaggactttgagaagttcctacataaactgcgttccgaagctgaaattgagagagaatgtgtggcatcactatcgtcatcatcatcatcatcaccatcatcaacagacaactacaactttgaggaagaagaatactaagagaaaccagaaatgaactctattcaagaataatgcatacaattcagtggtatcagtttaattgtaacaatatatttaattcaagtccaatccatgtaatcagtattaagagtgtgttttaccattcatctttaaaatcttcaaatcaataaatctcagtaagttattcttaaaaga

SEQ ID NO: 1346 - DNA, 1890 bp, Homo sapiens
gggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcatttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgatgaaagagtttttaaaatctggaagactcattttctctcagaagcctccattgctcttttgcatgactccttttggtggtggtttctccataaatttaggatatatcctgattgtttggcacaagccatatatgcaacgttccatgaagcatttccagaatcgagttacctctttaatgatgaatttaaagaagatctagggaataacatttttctttggtgttcaggtttaaaacctcaaaaaggcttttggatccactggaaactgaaagaactctccacaaccaccattcatggtagcaaaaaagcacctgcaaaatcagtaaaggaaagaattgcagacagtcaagaacatatatcaactagtatcgacttcaatattataaagattctgaacaacccaagagcatatacgttgcccatatccaaggaagaatcaagattatcaagactagcaacaaagtcgcactatagtagtactggtccagagtttaatcgtgttctcttcaattttggaggtcagagtccattgattttatattatcttaagatgcatgagctggctggtatttccaaagcacctaagaaaaccaagattaaactcactaagatattccaggaaccactacctgctccaacataccgtgatgttataaaggaggcaaaaagacaatttgcaaggaaccaaaaggattttaggatactccaagcaaaggctaccaagaaacctcatgaagtgaaacaggactttgagaagttcctacataaactgcgttccgaagctgaaattgagagagaatgtgtggcatcactatcgtcatcatcatcatcatcaccatcatcaacagacaactacaactttgaggaagaagaatactaagagaaaccagaaatgaactctattcaagaataatgcatacaattcagtggtatcagtttaattgtaacaatatatttaattcaagtccaatccatgtaatcagtattaagagtgtgttttaccattcatctttaaaatcttcaaatcaataaatctcagtaagttattctt

SEQ ID NO: 1347 - DNA, 792 bp, Homo sapiens
caaaattgggaagcggttctcgaaacatactgtcaaggcgtagttgcagtgagttgtgaagaaatgttgatcccagagaaaagtttgcattttgcccacctcaaagatattttgattgaatttcaagaaagctgagaatggagtggtcaataaaggcttctttttcggacttggtttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgat

SEQ ID NO: 1348 - DNA, 1596 bp, Homo sapiens
aacaggctgggacgacagcggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcagtgagttgtgaagaaatgttgatcccagagaaaagtttgcattttgcccacctcaaagatattttgatttttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaataaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgatgaaagagtttttaaaatctggaagactcattttctctcagaagcctccattgctcttttgcatgactccttttggtggtggtttctccataaatttaggatatatcctgattgtttggcacaagccatatatgcaacgttccatgaagcatttccagaatcgagttacctctttaatgatgaatttaaagaagatctagggaataacatttttctttggtgttcaggtttaaaacctcaaaaaggcttttggatccactggaaactgaaagaactctccacaaccaccattcatggtagcaaaaaagcacctgcaaaatcagtaaaggaaagaattgcagacagtcaagaacatatatcaactagctgaaagtgagaagatctagattcttatttgtgttggaccactaatgaccagtatgacttcgggcaagttacctgctgttccagagtctcagctgctacatttgtaaaattggtgtattggtctaatgcctctatggtgctttacaattctgtgatctgtgacttatactcactactaatataaggaacagggcacctacttttaaaagctgttattctttaaaaaggaggaaatggtttcacattgattatcagtgtttgatttttgcctcaataagaatattggaacaataaatgttaatttagagatggaa

SEQ ID NO: 1349 - DNA, 2082 bp, Homo sapiens
aaaatgcccagaccagcatccgaaagctggtctcctatacaaagcagaatccctgcctacaaagcagtttcccacctccgactcctccccacggcgaacagcccttctggatccaaccaacccaccaaccccaatagggcccagcacccagagggtccacaatccagagaaggagctacaagccctgtacttgcaagcctcgaacccccaactccaactgacctcccctctgccagagcaagaccacgagtacccgccgagagcggacctggctggctacacaaagccaggcgcccgaccagagggatcctccgggacgtcctccgccaccggggcgtccccgcccagccccgcccggcgcccggcgctcaccagctctcctccccctcctcctagcctgacagacgctccaggtcgtctagcaagccgccctcccccgccgccagcaagaaggtggcgtctcgcagctcctcgttattcgtccgcctcgggtccatccggccccgccgcccgactttgcgctgagacccaaggggaagccccgaggggaccccgcgccgtaggagggagtggaggagccggcgaaccgcgatggagccggggcccagcacagcgcgagcggctcctcggctgttcgtgctgcttccccagcttcttcaccggcacctgcagcttccgcacctcctggtccgcgttcacgttagagttaacgtcctccatcccggccccgctgcctccgccgcccgcggccctctcgctctcgcagcaacaagggaagagccggaggaaagaggcgtccacgccgctcactccagccgaggcccccgcatatagcagggccaggccccgtcgccagggttcccccagcgcgggtcccgaagcaccgctggccacagatgaaccgcctcctcagcgcaggtccgggattcggggaggcagcgccaatatccggtctctgcagccatcttccctccgtccctccgcccaccgagggtcggccctgtaggtgacctcagagcgtcggggatgggcgtggccccgtcgggcgctaagaagacctagcgcagagaggaccgccgagctcccgacggggcggggccaggtgtgtgaggggcggggattggacccggaggggcgtgtctggactgccggcggaagtggaacgcggcctgacctgcgacggaaagccactgcaagcccggaggcgaacagaaggcattccgcgagccgggctgagttggtgaacacggtcctcgttcaccccgcctattggtctgggcgtgtggggtattctccacccacttatacggcgtgtgggaccgacgggcccgtcctgcccggctccggtccggatctcgagtaggcgctcaatgggattcggggagacgtagtttactttgttcagcaaatatttaaccgatgcctattttaatgggagattgtttccgctggcgggagcctcagagaccgcctgtgtcctttaagaaacccgaatttcagacagttaagagaggtctaaggtcaaaataataatcataatttcttcttactggccagatactatgctaagccctttttaattttattattattatattttgtcaccgaggctggagtgcaatggcccgatcttggctctgcaacctccgcctcccggtttaaagcgattctcctgcctcagcctcccgagtaactgggattacaggcgggcgccaccacgcctcgctgatttttgtattttagtagagacggggtttcgccattttggccaggctggtctcgaccctgacctcagggtgatccgctcacctcagccactcaaaagtgctgggattactggcgtcagccaccgcgcgcccggtcgtgctaatcactttgaaaggcattatctcatcggttaaaacatagttttccggacttaaaagtttacagcacactggcgcagaagatggaaaaccgctgcttgcctttctccgtttattgactcacattctgctctttggatcattttcttcggaaaaagttttccaaagtgtgtcttgtgtattaaaagttgtgtattaaaagtatttgaacacgctg

SEQ ID NO: 1350 - DNA, 2670 bp, Homo sapiens
cgccattcccggatccgccggctgggaatcgcgggtccccgcgcgtcctgcagcacttcccgcgccgcgcccccagcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggatgactgagggacgtggctgcctctgggggcaccagcaccttctgtagcattgtggaacatttcttccatgaacttctactctggagctggagagaacagtctgccaagtcttacctggttcttccccatagccaccttggaatactctttgaacaagctctgctaaaaccaaacccatgaccactgtgttggtggtggggcctcatgctgtggctcagggagggcccctccctgcatgtgagtctagccttcctagacattacatgatgaccctttaaaaaaaaattagagatggaggtctcactatgttgcccaggctgatctcaaactcctggactcaagcgatccacccccctccacctcccaaggtgttgggattacaggcgtgagccactgcacccagcctcatgttgaccctggccctggatagcagctttgtttgtagaggcaggtggtgggagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttcctggtagatgccattcccagagaggccaacagcgttcccaggcgtggctggctggtccgcatctctcagactcactctgccaggctacagttttgagaataccttttttgttgttgttttgtacctggagaactttttatgaatgagtaaatcttcagaaaggaattcctccacccttactgggttattgtcaggtgtaaacggcctttcagctgagcaatgttcctatgagaaggaagccatttctcttggctcatgaacactgccttttgggtagtatacccacacccagatctgtgaagagacctggaattgaagtctccatgtcgtcaggacttggtggcatgtggatcttgcttgacttgggaaaagagagggtggtggtgaactaataattatggagtccccctaatgtgtcgaacacaatgctagatgatttccatgataataattactcatacttgtgctaagcacttgcgatatcgtacttctcacaacagtccatgaggtactgattattattcccattttctcatgagactaaagctcagagctctaggatagtatacagtggcaagaggaatttacatccaagcactcagatttcaaagcccacattcttaactaccggactattcatattacagagcaggaaaagggtctcagacaggttaagcaacctgcccagagtcacacagctaatgagtagcagaatcaggattcaaacccagagctgtcaaaagcaaaccttatgttccttccactgtcccctgcttccttgcccttcagaaaggtcttggaaacaggggccagaggatgtggtagccacttcactggtgttctgtgtctgaatgggactttctcacaggcaggccatgctgggacctcagccatgggggtggccagggaggtggttgagcagaaggatagctggggacactgactgggggtagagtcacccagtgtctttagacatcctgctgtctaaagcactgtgtccaaagggtatggcacacttatatggacaggtcaccattccaaacaaggaggcccagtgtgtcaataggagaggtcctaaagcaacaaaaagggcggggtgtcttggatgggc

SEQ ID NO: 1351 - DNA, 4517 bp, Homo sapiens
actcagcaactgccatacagcaaaaggagggattgcaactaccatgcagcaactgccaccttgaaagagaaggggttgaagagtagtctctaatatccagcaccagttggccttaggttccctgcctccagaccttattctcctgcaacatcaccactggttgaaaccttactacaaatcaagctgtgaagtcactggagccctgtagcaagtcatgtccctgtaacgatgagtgagctgacagctaaggggcttgcctaaaccacacaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 1352 - DNA, 4425 bp, Homo sapiens
agacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgcgggctgtgccacagcctggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggagggcgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctgctccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 1353 - DNA, 1872 bp, Homo sapiens
cctgccccatggcaggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgactttgacactgaggctggagctgtgtcctcctcagagcccactgtggccagaggtgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccaccctt

SEQ ID NO: 1354 - DNA, 1700 bp, Homo sapiens
gcagagggctcttccggcgccttcccaggcggggatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagaccagcctgaccaacatggtgaaaccccatctctacgaaaaatacaaaattagccagatgtgatggcgcatgcctgtaatcccagttactcaggaggctgaggcaggagaatcacttgaacctggggggcggaggttgcagtaagccgagatcgcgccgttgcactccagcctgggcaacaagagtgaaactctctccccccgaaaaaaaagaaataaaaaatacatccttgagaaacttttttattgctaatggtgaagaggctgttaaatagaaaaatatactacatgcacagaagaacatgggggacatatatatatgtatatattcgaataagactccaaaaagtagaaatttaaaaagtgctatacattgcatcaggttctaaaatcccaaaccccaaacagcctggaacatgttactctgatttcatggcgttgtaaaataacagagctgggaagaatattcaagatgacctgatttaacacctttcattctgttggggggcctttgatttcctatatccagaagttgagagacttactcaagattgtaccatgcaagctggcaactagaacccaaatccttggactacttgttgaatgcagtttttctagattgtaaattaaaaatcatatctccacaacggttctggaattctggggattgccttctaatccagtttacaagtgacagaaaacctgttatgctgctttgtagtcttaccttagatttttaaatgcttatttaaatgtaaaaaaaattttttttttacatcttttaaagactatatttaccattttgttgaaaaagtaaagaaaaatcatgacttgtaattaaatgtgaattataatttttgagaagtcactgaattttcatcttcctctaataacttaaataatcagcaaattcagtagtttttatgaatctccaaagatccttaaaagaagaaagaggacttggaagctattttcagtatttgtaaaagcttgtcagaaattacatctatattaaagtttcaaaagctaataatatatttttacatcttcaggtcaagttatagtaatttattaaagaaaataaaattaatttcctttgctgatcagga

SEQ ID NO: 1355 - DNA, 552 bp, Homo sapiens
gcagagggctcttccggcgccttcccaggcggggatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagacaggatcttgctacattgcccaggctggcctcgaactcctggcttcaagtgatcttcccgcctcggcctcccagagtgctgggataacaggtgtgagccaccatacccaaccagctttattactgatttccctctaaaaagagactcaagt

SEQ ID NO: 1356 - DNA, 1453 bp, Homo sapiens
agagggctcttccggcgccttcccaggcggggatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagaccagcctgaccaacatggtgaaaccccatctctacgaaaaatacaaaattagccagatgtgatggcgcatgcctgtaatcccagttactcaggaggctgaggcaggagaatcacttgaacctggggggcggaggttgcagtaagccgagatcgcgccgttgcactccagcctgggcaacaagagtgaaactctctccccccgaaaaaaaagaaataaaaaatacatccttgagaaacttttttattgctaatggtgaagaggctgttaaatagaaaaatatactacatgcacagaagaacatgggggacatatatatatgtatatattcgaataagactccaaaaagtagaaatttaaaaagtgctatacattgcatcaggttctaaaatcccaaaccccaaacagcctggaacatgttactctgatttcatggcgttgtaaaataacagagctgggaagaatattcaagatgacctgatttaacacctttcattctgttggggggcctttgatttcctatatccagaagttgagagacttactcaagattgtaccatgcaagctggcaactagaacccaaatccttggactacttgttgaatgcagtttttctagattgtaaattaaaaatcatatctccacaacggttctggaattctggggattgccttctaatccagtttacaagtgacagaaaacctgttatgctgctttgtagtcttaccttagatttttaaatgcttatttaaatgtaaaaaaaattttttttttacatcttttaaagactatatttaccattttgttgaaaaagtaaagaaaaatcatgacttgtaattaaatgtgaattataatttttgagaa

SEQ ID NO: 1357 - DNA, 575 bp, Homo sapiens
gcagagggctcttccggcgccttcccaggcggggatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagctctgctattccattcctcaacaattggaggagactcaggagggcgtttcaggtattcctgatactccttgtcattttctgtgaatctactagcaaacatctcttcaaactttggaacagcttcggcagtgtcagtcattctgaaaatctgtacaattttaaagacatttccatt

SEQ ID NO: 1358 - DNA, 2578 bp, Homo sapiens
agattgcatactcaagaagaggaggaacataaaatacgtgatgtcttctcttaagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaatt

SEQ ID NO: 1359 - DNA, 2460 bp, Homo sapiens
aagccaagctagggcactctggtgtacagccagtccccgccgcggaggtgccggtggagcctgggaccgggcgagtctccgccccgcttttgcagctaggggtgtgtttcaggggggattggggcaagccaagcaggcgaggacccgggcctgtgccgctttgcctacccctcatccctcggcaccaaggctacttgagccccagggtgttttttccttgttcccgccacctcctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaatt

SEQ ID NO: 1360 - DNA, 2618 bp, Homo sapiens
aagctcagctttctgtttagttgtgagattgcatactcaagaagaggaggaacataaaatacgtgatgtcttctcttaagtcaatcgcaggccactctgctgagcatcttctcccaggagtaccagaaacacattaaaagaacacatgccaaacatcatacttcggaagcaattgaaagttattaccagaggtacctgaatggagtggtgaaaaatggagctgccccagtgctcctggacctggccaatgaggtggactatgcgccctcattaatggctcggcttatactggagaggtttctacaggaacacgaggaaactccaccctccaagtctattataaatagtatgctacgggacccttctcagattccagatggagttctagcaaatcaggtctatcagtgcattgtgaacgactgctgttacggaccactagtggactgcatcaagcatgccattggtcatgagcatgaggtcctgctgagagacttgcttctagagaaaaacctgtccttcctagatgaagatcagcttcgtgcaaagggttatgacaaaacaccagacttcattttacaagtaccagttgctgtagaagggcacataattcactggattgaaagcaaagcctcatttggtgatgaatgtagccaccacgcctacctgcatgaccagttctggagctactggaatagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccactacctctttagacaaacatatcaagagtttctgttttccttcatcccttgctgatgtgaacagccaagaactacagacacaacccactcattatcagcatttctgtctctgtcaaacaattagtttatagatagtcataatctttctttcttccggatggtttatccttgtatgctgaacaaaagaaaaaatgtgaagactgaaaggtgtgatttttcaattctcctcccagttaccgaatcaccctcttatttttttttccctaagcctccgttcactgtctctccctctccctttctcttcatgtgcactcacagagacccagcattgcattaccatcgtggaataatctagcgcaaacctaggaaagctgaagccacaaagtccaaagccacctttgtactcacctgcagagctccagaagaccttgatggcagcctgcctatgctgtgtgtttgctatattcaatctttacggcttcctgacttctgtgacagtaagccaagtgcaaaaatacacttgatgagaatttcctcttttaataatgttatttgaacaccacatattttagatttatcttatttgaaagtattagttccattgtgcctggaaaccacactcctttagattgggggccgagaggcgacaacccaacattgaggagagtttatttttaaacatggctagttgtcagtatgtacgtgagctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaagg

SEQ ID NO: 1361 - DNA, 1281 bp, Homo sapiens
acaggcttggcgacgccatgtttcaagggcagcgcggttggttttgcggcagcgttagccaggatctgaggcaattctgggtggctgaagggggaacgatcagtgacccgcgagccgccgacttcttgttcagctgtgatgcctcgcacccagacacgctgagaatatatcagagccttgattacatagaagataatgctacagtttttcatgcctactatctctctgcggtagctaatgccaaaataaaaaactcggtggctttgggtcatttcattcttcctcctgcgtgcctgcaaaaagaaataagaagaaaaattggtagttttatttgggaacaagaccaacattttctgatagaaaagcatgatgaagtaacaccaaatgaaataaagacccttagggaaaacagtgaactagcaacagagcacaaaaaagaattatccaaaagcccagaaaagcattttataagaactccagttgtagaaaagcagatgtacttccctctacagaattacccagttaacaacatggtaacaggttatatatcaattgatgccatgaagaaattccttggggagctacatgacttcattcctggaacctcaggatatttggcatatcatgttcaaaatgaaattaatatgtctgctataaaaaacaaattgaagaggaaatagtaaattaaattgtaaataccttggcatttattttctataaaatattatacagatgtgcatatcataaaatgctcccttttggtactgggggatagtgaaatgggaaataatttttctgtttctcaaagtatatctttaggaaatacagaatcattttggttctgtgttttgacatttttcccctagcttttaacaacatgttcaaatattctcaatgcacagttgttaatgagtaattgccgttaaaatatatttcataagaagtctcaatctcaaactctccatctctcaatcctcctcctcctcctctttcttgctttctcttttccctctctctttctctcctccccttctctctttctgtctttcaaatgttcttttggctttaacattctattaattatattttttctagattgaatactgtgaatgctaagttttattaatctggtcatcttattttgattttaaaaattaggatgctagttgcattctgaattactgtttctggtttgaaacatggagaaaaacattttaataattcatatttcatgttggatggtttctaataataaatatctcaaaagtgacttaacataaa

SEQ ID NO: 1362 - DNA, 2279 bp, Homo sapiens
atgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctag

SEQ ID NO: 1363 - DNA, 2611 bp, Homo sapiens
agtttatgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaagcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaatggtttcactatgaaactaaa

SEQ ID NO: 1364 - DNA, 1741 bp, Homo sapiens
aaggaccgccccgcccagcgcggagtgcaggcgccggattcccttctgtcgcgcggccttatagttccggctgtggcgcgcggacggaaagtttatgccgacggaaagtttatgccgacggactgtgtccggcgatgggcacggggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcct

SEQ ID NO: 1365 - DNA, 1853 bp, Homo sapiens
atgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctg

SEQ ID NO: 1366 - DNA, 1815 bp, Homo sapiens
aggaccgccccgcccagcgcggagtgcaggcgccggattcccttctgtcgcgcggccttatagttccggctgtggcgcgcggacggaaagtttatgccgacggaaagtttatgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgag

SEQ ID NO: 1367 - DNA, 3690 bp, Homo sapiens
cttgatgcagagacatggcttgcccagggtgactcctgggctggggccgccaggggagctggctctctccgccccgactaccagcagctttcggcctggagaggctgggcccctgggagcggctctttcctccaggctgggcacaggcctaggtgcggggtccagggcctgagagcccaggacggagccagggcctctcctttttctctggttgtggatctgggagccaaacagctcccccctcgacctcccgaatcccctggcagcttcccagtcacggcaggttccgctgccagagccatttataactcccattccaggctctgctcggcagtgaagctccctggagagctgggggaggggcaccccactgctgggagctgtggcttggggtatgaggccctgacctgagccccctgaggaggcagggacaggcagacgggcctagctggaatgggggcttggggccttatttgggccatctccctaagcaatccccttccttcctgggtgaccttagctgtgggtctgggatctcttccttgggtggtgaaaatgtgaaagctggggactggtgagagggggacccggaagtcaggagcttgggttccctgcctctgcagggaactcccagagccgagtcccccatgagcaggcaggagaaggacgcagagctggatcggaggatagttgccctgcgcaagaagaaccaggccttgctccgcaggtaccaggagatccaggaggaccgtcggcaggcagagcagggggggatggctgtgaccacaccagcactcctccagcctgatggcctcaccgttaccatcagccaggttcccggtgtaagcctcaccctgggagacagggctcgtagcaaggaggtggaggcccagaccatgtcggggaaagacagctgcctctgttcccctctcctactaactattctggggtgcacctgccagctcccaacctcctgcagtcggaccactgctgtccccaccaaagagccacagctgaaagcccccctacccccagtagatgcatcttcatacccttttccagtccacagccctgcgcctatgccacaaagcacaggccactcctaaacctcaagccccaggggctaaaaccctgcaggaagtgggggacagagaagttggggctgaatgccaggagcagtgtctgagggacagagacccattgtttgagtgctctgggtttcccagctcagagatgacgggccactgtggcatcttgggccgctgggtggccctgggccctggataacctcatgccattggcatgtgaacaccctgtgggagtcagctcttctgtggggaatgcagggagggctggggttggaacccaggcctggggaaccaccgagaggacccagcacccaggtcctgcccagcactgcccatgtggcctgagggtctttgttctgcaggaaaagcgggtggttagcaggaactgggcaaggggtacctgtggacccagagtgaccaacgagatgcttgaggatgaggatgctgaggaccacgggggtactttctgcttaggggagctggtggagctggctgtgaccatggagaacaaagcagagggcaaacggattgtaagtgaaaagcctaccagagcaaggaaccaaggcatagaggggtcacctggagggcgtgtgacccgaagcccccccacgcaggtggccatcagctcagattctgcacggaagggttcttgggagccctggagccggccggtgggggagcccccggaggcgggctgggactatgcccagtggaagcaggagcgggagcagatcgacctagcccgcctcgcccggcacagagacgcacagggtgactggcgccgcccgtgggacctggacaaggccaagtccacgctacaggactgcagccagctgaggggagaaggcccggccagggcaggcagcagaaggggtgagcccacacctacctcatccctcccctccttggctttgttcatctttcacccccttgtcctctcttttctctgtctcttagtctcttattttcagagctgaaaggaagcgttggagaacatcttccttcctctccctcactatcagaggagggcaccaagacctcccatcctcccctctgagcccacagctcttgtccaggttctgagcagaaggccccagaaggaggctcagtggaagccggcccggggtctctttgaggtccctaaagggtgaaagtcctggtggtccttccccagacctactgtagaaacagctctgtggagttctggtccccttgttttatatataaagaagctgtggcctgagagttggggccagacacctagccatggagtggcaaagctagcacaggaccctattctcctgacccccaggcgagggcgcttttggggaggcaaaacccacgactggccccgaggactgacagcttcctgaggctggaagaactggtgttcctgttttggatcctttgtcaccccacctttccccacttcttttgtcccccgcaggtcccaggagccaccagaaactacagcccccaccattgctccctgatggaaaaggtgagttggggaggaggaggggccaggtctcgtcagctaaagatggagccggctgctatgggcctcttctctccttggccgaccatctcttgcaggtcggggcgggcaagccagcagaccctcggtggcaccagccacaggcagcaaagcccggggcaaggagaggctgactggcagggcccgaaggtaacaggtggcaggagagctcttcttcaagataaggaagtggtagttatggtggtaacccccggctatcagtccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaaggtggagggtcttcatgaaacacagctgccaggagcccaggcacagggctgggggcctggaaaaaggagggcacacaggaggagggaggagctggtagggagatgctggctttacctaaggtctcgaaacaaggagggcagaataggcagaggcctctccgtcccaggcccatttttgacagatggcgggacggaaatgcaatagaccagcctgcaagaaagacatgtgttttgatgacaggcagtgtggccgggtggaacaagcacaggccttggaatccaatggactgaatcagaaccctaggcctgccatctgtcagccgggtgacctgggtcaattttagcctctaaaagcctcagtctccttatctgcaaaatgaggcttgtgatacctgttttgaagggttgctgagaaaattaaagataagggtatccaaaatagtctacggccataccaccctgaacgtgcctaatctcgtaagctaagcagggtcaggcctggttagtacctggatggggagagtatggaaaacatacctgcccgcagttggagttggactctgtcttaacagtagcgtggcacacagaaggcactcagtaaatacttgttgaataaatgaagtagcgatttggtgtg

SEQ ID NO: 1368 - DNA, 4717 bp, Homo sapiens
ggtgctacggagatcctccccattttacacgaggaaatgagacacagagagggttcttgggagccctggagccggccggtgggggagcccccggaggcgggctgggactatgcccagtggaagcaggagcgggagcagatcgacctagcccgcctcgcccggcacagagacgcacagggtgactggcgccgcccgtgggacctggacaaggccaagtccacgctacaggactgcagccagctgaggggagaaggcccggccagggcaggcagcagaaggggtcccaggagccaccagaaactacagcccccaccattgctccctgatggaaaaggtcggggcgggcaagccagcagaccctcggtggcaccagccacaggcagcaaagcccggggcaaggagaggctgactggcagggcccgaaggtgggatatgaaggaagacaaggaggagctggaaggtcaggagggaagccaaagcaccagagagactcccagtgaggaggagcaagcccagaagcagagcgggatggagcagggccgactggggagcgcccctgcagccagcccagccctggcatccccagaggggccgaagggggagtcagtggcttccacagccagctcagtcccctgctctccacaggagcctgacttggctcctcttgacctctccctaggaggggctggcatccctgggcccagggagagcgggtgtgtgctcggtctgaggcctggggcccaggagagccctgtgtcttggccagagggctctaagcagcagcccctggggtggagcaatcaccaggctgagctggaagtacagacttgccctgagccacagagaggagcagggctcccagagcccggagaagacaggtctggcaagtctggggcccagcagggcctggccccgagaagccggcccacgagaggaggcagccaaaggtcgagaggcacagcaggtgtgaggcgcaggacagggcgccctggcccggcaggaagatgctgaacacagctcctgggagctggggagtccccggggagaggaaaagggaatcactctgttaaaggccctccgcgtgatggccatgtggttgccggtggcttgcgccattgtcactgagcagtgtggcaaactctccagcatggcgaccttgtgagggcaaggagtggcctccctgcacctcacacgctcatctctgtgcacatgtgtgttttcacgcacgggcacagcccctggtgtattcctgtactagtatctggcatctgaggctggtgcaccctgacctgggcctactgctgcccaggccacaagccttctccactatgatgagagaacaaggcttggtggcacccagcacctggctctcctggctccccgtcacccccccagggcctggcctccctctccagctgcaggctttcacctcttgcctgggctggattcccccagtcccagattcccaggatgcccaaccaggggaatcccagtaaccatgcgccagcctcctgcctctcctgagtggtggctgaggcctggaggaggagaggccacacagctggcagggtctggcctgggcaaagaagagtagagctcacgtcttcttggtgaaaaggaggatctctggaaagtcctcctctctgaaatgggttgggatggggagcgacaacctcctcttcccacagcaggatgggagagcttactcccaggcccccacacccaggtcagacatcacgtgcaccctgaatgtaggcaagggcctggccctgcagcccagggtcatttcctgctctttccacttcctctttccccaccgtcctgcactagcaccagggccaggccaaggcaagaatcagacagctactccacagacagagaaacaacttccagctaagtatgacatcaggacttgtctttcctactaagcctccatccccgcccctcccctgaggcccacgtctgctgaattatccggactccgcacaagctgtggcttcctctcagttcaacaaacatttcctgagcacccactaccagtaatccagccggtaggcgacggagactgccagcaggagggagggaagaaagccagtcatccggcagatctgggctgttctgggcgggagctgttctgggccacaggtgccctacagggctgggggcaggatggcggtaggagccccaggggaccctcccacctctgcctggcagaagcaagtgcccttctttcttgttatgtgtgccttctgctcctgagccctagtgtggacctcaccgcatggtcccctctgccccctccttctggtcctgccatggctgctgctctctgctgaaggctgtggggctctagggagagtccagatcaccctgggatttctccactgcccaatgtgaagcctaaactgtggggtcccagctcagccttcctcactggctctcaactccaccccacccctctattcaggaaggtgaggggcatctctttagcagaccagactgttttgagaagtgtctctcatactttaactgaagagtcatgcagattctaatggtctggggagggcctgagagttcgtcttttttttttttttttttttttagttagggtcctgctgttatcacctaggctggagtgcagtggcacaatcatggctcactgcagcctcgaaccctccaggctcaggcgatcctctcacatcaacctcttgagtagccgggactacaggtgtgccaccacacctggctaatttttgtattttttgtagaggcagggtttcaccatgttgcccaggctggtctccaactcctgggctcaagcaatctgctcgccttggcctcctaaactgctgggattacaggcatgagccaccacacctggccgagaattcgtatttctaagaggcttcaggtgaagcccatgctggttcctggaccatggttttgagtagttaagggtttggactagaatatatgaagggctgggggtgaagacagactctagactctaaaggttggtggctggctatgtaggggatgggggagtgctacccctgtcaggtggtgggggcttcctggctgcagagttgggtgggagacttggggaagatgctttggaaggcagtgagtgggtggtgtcaacttctagtagtgcagtgggagagctggtcagggatgggatggagtgaagggggcagaggcatttggtgtggggttgatcagaggaattttggaaaggcttggaaacattcctatgtatgtgagacacacctatgccagggcaaagactccaagctcaagtttttctcttgccttctagtcacaagaacatggctttggagtgtgacactggcctaggaatccatgactcccaaaggacggggctaggggtagaggaggttcaggcaaagcccttagattttggagacatcaggcagatgtctccaaaaatgattgtgatcaagaatctgaattataagattcacagtctgctccccaacccagtgctgccaactgtacagctgcgcctccacgaaggggcatatgccaggctcgtctgaccctggaatgaggatgtaggaagcaggcagagctcgggttcagccctcacaatgggactgaagcaggagagaaggctgggcagaagggctgtggggaagtagggcttgtctccatggatgacgtccagaaggatgtcaggaggaggaatatcacaggagttatagacattggagggaacagagactggcacaggacctcttcattgcaggaagatggtagtgtaggcaggtaacattgagctcttttcaaaaaaggagagctcttcttcaagataaggaagtggtagttatggtggtaacccccggctatcagtccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaaggtggagggtcttcatgaaacacagctgccaggagcccaggcacagggctgggggcctggaaaaaggagggcacacaggaggagggaggagctggtagggagatgctggctttacctaaggtctcgaaacaaggagggcagaataggcagaggcctctccgtcccaggcccatttttgacagatggcgggacggaaatgcaatagaccagcctgcaagaaagacatgtgttttgatgacaggcagtgtggccgggtggaacaagcacaggccttggaatccaatggactgaatcagaaccctaggcctgccatctgtcagccgggtgacctgggtcaattttagcctctaaaagcctcagtctccttatctgcaaaatgaggcttgtgatacctgttttgaagggttgctgagaaaattaaagataagggtatccaaaatagtctacggccataccaccctgaacgtgcctaatctcgtaagctaagcagggtcaggcctggttagtacctggatggggagagtatggaaaacatacctgcccgcagttggagttggactctgtcttaacagtagcgtggcacacagaaggcactcagtaaatacttgttgaataaatgaagtagcgatttggtgtga

SEQ ID NO: 1369 - DNA, 3022 bp, Homo sapiens
cttttgtaatcacaacatgatctcgtgtgctgagcagcgaagccggcagggagaggccggcagaggcccggctccggtggctccagctttcctcccactctggctccccaggggctgctctggaattctctcggtgcccgccgttgccatgcactcggctggaactcccagagccgagtcccccatgagcaggcaggagaaggacgcagagctggatcggaggatagttgccctgcgcaagaagaaccaggccttgctccgcaggtaccaggagatccaggaggaccgtcggcaggcagagcagggggggatggctgtgaccacaccagcactcctccagcctgatggcctcaccgttaccatcagccaggttcccggtgaaaagcgggtggttagcaggaactgggcaaggggtacctgtggacccagagtgaccaacgagatgcttgaggatgaggatgctgaggaccacgggggtactttctgcttaggggagctggtggagctggctgtgaccatggagaacaaagcagagggcaaacggattgtaagtgaaaagcctaccagagcaaggaaccaaggcatagaggggtcacctggagggcgtgtgacccgaagcccccccacgcaggtggccatcagctcagattctgcacggaagggttcttgggagccctggagccggccggtgggggagcccccggaggcgggctgggactatgcccagtggaagcaggagcgggagcagatcgacctagcccgcctcgcccggcacagagacgcacagggtgactggcgccgcccgtgggacctggacaaggccaagtccacgctacaggactgcagccagctgaggggagaaggcccggccagggcaggcagcagaaggggtcccaggagccaccagaaactacagcccccaccattgctccctgatggaaaaggtcggggcgggcaagccagcagaccctcggtggcaccagccacaggcagcaaagcccggggcaaggagaggctgactggcagggcccgaaggtgggatatgaaggaagacaaggaggagctggaaggtcaggagggaagccaaagcaccagagagactcccagtgaggaggagcaagcccagaagcagagcgggatggagcagggccgactggggagcgcccctgcagccagcccagccctggcatccccagaggggccgaagggggagtcagtggcttccacagccagctcagtcccctgctctccacaggagcctgacttggctcctcttgacctctccctaggaggggctggcatccctgggcccagggagagcgggtgtgtgctcggtctgaggcctggggcccaggagagccctgtgtcttggccagagggctctaagcagcagcccctggggtggagcaatcaccaggctgagctggaagtacagacttgccctgagccacagagaggagcagggctcccagagcccggagaagacaggtctggcaagtctggggcccagcagggcctggccccgagaagccggcccacgagaggaggcagccaaaggtcgagaggcacagcaggtgtgaggcgcaggacagggcgccctggcccggcaggaagatgctgaacacagctcctgggagctggggagtccccggggagaggaaaagggaatcactctgttaaaggccctccgcgtgatggccatgtggttgccggtggcttgcgccattgtcactgagcagtgtggcaaactctccagcatggcgaccttgtgagggcaaggagtggcctccctgcacctcacacgctcatctctgtgcacatgtgtgttttcacgcacgggcacagcccctggtgtattcctgtactagtatctggcatctgaggctggtgcaccctgacctgggcctactgctgcccaggccacaagccttctccactatgatgagagaacaaggcttggtggcacccagcacctggctctcctggctccccgtcacccccccagggcctggcctccctctccagctgcaggctttcacctcttgcctgggctggattcccccagtcccagattcccaggatgcccaaccaggggaatcccagtaaccatgcgccagcctcctgcctctcctgagtggtggctgaggcctggaggaggagaggccacacagctggcagggtctggcctgggcaaagaagagtagagctcacgtcttcttggtgaaaaggaggatctctggaaagtcctcctctctgaaatgggttgggatggggagcgacaacctcctcttcccacagcaggatgggagagcttactcccaggcccccacacccaggtcagacatcacgtgcaccctgaatgtaggcaagggcctggccctgcagcccagggtcatttcctgctctttccacttcctctttccccaccgtcctgcactagcaccagggccaggccaaggcaagaatcagacagctactccacagacagagaaacaacttccagctaagtatgacatcaggacttgtctttcctactaagcctccatccccgcccctcccctgaggcccacgtctgctgaattatccggactccgcacaagctgtggcttcctctcagttcaacaaacatttcctgagcacccactaccagtaatccagccggtaggcgacggagactgccagcaggagggagggaagaaagccagtcatccggcagatctgggctgttctgggcgggagctgttctgggccacaggtgccctacagggctgggggcaggatggcggtaggagccccaggggaccctcccacctctgcctggcagaagcaagtgcccttctttcttgttatgtgtgccttctgctcctgagccctagtgtggacctcaccgcatggtcccctctgccccctccttctggtcctgccatggctgctgctctctgctgaaggctgtggggctctagggagagtccagatcaccctgggatttctccactgcccaatgtgaagcctaaactgtggg

SEQ ID NO: 1370 - DNA, 2043 bp, Homo sapiens
ctgttctgatatggagctacaaggggcccaagaggacctgggcatttccctctctagtccccggaggaaccatgaaaccaggccaggaagcaaggctaagggcaggagcagcatctgtctccaggcgtctgtttggatggctggaggaaagctgaggctcagagcaagtgaacatctaacccagggccaccaacaagagctcagggattggaatctgggagaagatgcttcccttctcttctccaagagtccttttggggctggcaagttgatacaagctccagctcatgtcttcagacaatgctgggtccaaggaaatgcatggatctcctgcattacaaagtttgactccaagagaagcccagaagtggcttccagcccctcctacctaactgtgccccgccgttcaccacttcctgtcttcctgcgacccagtgacagatgtgtctgtgggggctgctacttgggaaagtccaccaggaggagagcatgccaatctctcctctcagatcctctgggggttactttccccacccaaactaggccttgatgtcaaggcctagttacagggatgtcaaactaggaggttgatgtcggtgtggtgtgtaagatgttggggagaagctgcaggtgccttcttaccagctcttcctgaaaacttgtctctccctctccttgttagtctgttttataactcacactccagccggggggaagtaaaggagcttatcccgttcacagatcctgtaacccatggtggttattacctcatagctggtgcagtgttctttgagcctagcagtttggtttagactcaagtgtctattctttgcagtctttctggggttggtagcagagaaagagaagagaacaggtaattcgatcactcaggttattcgtgtgtaaaagttgaagccctaccacaaacgtatgagtggatgttatagtgtaataacctggacattgccaagacagcttcctcagggcttttgtttcctcaagcctacctgaaggctctcttctcagtcacgggggatggaattgtttcatccctggcttgctctgggcctcagtttccctattccaggatagtttccctattccctattctgcatcataaaaaaaaaaatacactcctgatagaagtcggttgatgcttttggcctgcagcctccttaaggttaatagtccacataatttcctcaggggccctggctggcctgttgtgggtgtacccatgaagtatcttgatttgctatgataggagccaccttggcttcctgtggagataagccctgcccctcgttcccactttaagcttgaaaagtcccttatccaactttggaatgggaactagaaagactaagcagtgtctctcaggggttccttctggggtcactcagaagaggagaaccaagcagtcttggcggagagacacctgaagttggtcactcggcacattaccaggggctcagcaatgaccagcctgcaaccatcctgcctttccccaggggtctgggctccagccatggagggtggactggagactcctttgcctttcaacactgtctggcctgtctcgggtccggcacgtcttttctctactgattttgtggctgtggttaacttagctaacctttcagtgaaataatgtctagtggcattcctttacattttccatgtgctgttttttccataactccattttcttcagggctgagtttgggtcttcatttttccacccacaggcctagttaagcttggtcttgtgctccaacttacctgccccagacttcttggatggacattgtcaatctggtcatattgagagtgaaactgccacctagtggtcactggaggtgtgcctgccttttcatgagctctcttgctgctggttaccggaaacatcagttgatggttttcttctaagctaactcagaagctgtgatgtgaatcagaccaaacaatttatctgcttcaaatccatattgtaaagaggtttaatataaagacatattttcaaatcaaaataaataatgaagc

SEQ ID NO: 1371 - DNA, 3078 bp, Homo sapiens
tccttcagcaggatgtacacagagatataactttctacagcatccactgcagctctgggctccatttccctttgaaatgggatgggagaaaggggcaggtaacagactggagtgaggagactgaggagaaactgtagagaataatacttaggagtacacgtgctggattctctcattaaggaaatattcatgagtcaactatccagaatcatagttattattcaagcggtgtgggtttaaaaggagatttgatgccatggcaaacctcactgacttagactgttcttcaagttaaagagcaggatgatgtctgaagtggctgaaacacatatggcttcagtgtgtcaagaagacctgaaagatcccacatggaagtgaaattcattactggcaagcacggtggcaggagaccccagagggctgagccgcaaagaatttgcagagccttatggctaactccatggcctagtttgatcttgaagttactgtcttggataatcctctcaaatctgttcctgcacttaagagccactcatcacatgacggagctccctctcaggttcctttacatcgccctgtcagaaatgactttcagggaacagacatcacatcaaatcatccaacagatgtccctttcaaataagttggagcagaaccaactatatggagaagtcataaacaaagaaacagacaacccagtgatttccagcggattgacattactctttgcacagaaacctcagtctcctgggtggaagaacatgagttcaacaaagcgtgtgtgcactatattggctgactcttgccgtgctcaggctcatgctgctgacaggggagagaggggacattttggagtccaaatcttgcatcatttcattgaagtgttcaatgtcatggctgtaagaagtaacccattttaataactggcatcaaaggatttaggagagagaaacccagtatccagacccatttccgtcagtgacactctcctcgtattgggaggattggccagaatcgtctgattcctgtttctgatttccttcctcactggcatcagagtatttcactataggaaaactaatatctaactgagctccaagtgctaaataacagcatctcatgttcattccgggtcaccaagaggttcagggtgaccaagtcacaaactataaatttgaacatttgatgatttttgcaggagactgggtgaacaaaggaaaacccgagagatacataaaggtggaaactaggatttctcatttgaattatttaacatgcctcactctaatggttataaatgtaaaggaaatgcaggttcttcaagaaggtgaaacgaagttactgaatttaagtttttttttttttaaacctactttagaataggaaacatgcttactaatatttacaaggcactacaaggcaccagccaaaaagcctgatttattggcaggatattcttgttgttgttgtttctattgtccatataggcaggcaattaatactttttagaaaattaagttgccaactcaacactgcctacttttgaatttttattctagcaacagccgataatttattggaaattccttatgtgctgggcactacgctagacattgggagtacgaaaattaatatggtaaagatcctggctttaaagagtctttaacattatttcagcagttttattacaggtgtatatgttggaattgacagaacacttagctcaaagcaagggttcaagcatgactttgcagagtagatttcagctgagcttaaaggatgtgagaataagtatacacattttttaaattacccagaatgtagtgcctacagaagtgcttgagcctcagttgcttctaagagtccaacttcagaacttgtatcttctagattgagctcattgcttaatttctagccaacatagcccatctctctcagctgaatactaagctcatcaacttctcctttgatctaggtcttgattagaatgttgaacatgacaaggctgaaggcagaaaccatagaaacttctatccagagttacactcgtctcttaatagctgcctactgttgcaatcagaataaactcacttcttgcccaattatgacagttcattcaccttctactcaagggagactttaagaattgttgaagttgaacttctcaggttcttatacttagtgacactgttcatgcaatggctcagtatttcttgatttctcagaaccagcaaaagtcacaaactgaatcctcaaattggaattcgtaagtgactaacttgtagcataactttattatactaggaaagatggggcaagggacagaaaaaatatctgtaacatcttatatgttcaaatataagcgctttatgtatatttagtcattcaaactccaaatacacattaagaagtagtcatcaatattccactctctaattctacaatttctacctttttagattccacatataagtgagatcatatggtatttgtcgctctgtgcctgacttatcttacttaacataatgtccttaggttcatccctgtttgaaaatggcagaattgcctgtttttttttttaaggctaaatagtatcctattttgtatattcagcacattttaaaaaatctgttcatcagctgacggacacttaggttgattccttatcttggctcttgtgaataatgctgcaatgaacacaggagctcaaacatccctttgaaatactgatttaaatatctttgggtataaacccggaattggctgtggggagttagacagggaaaatgtccacattgctctacggatacaaagtttcagttaggaggaataattctggtgttctattgcacagcacagtgtctatagttaatagtaatgtattatatatttcaaaatagctaaacaaagagaattttaatgttcttaccgcaacgaaataattgtttcagaaaataaatatgctaattagcctgatttgctcattccacagtgtatatacatgtatcaaaaagtcacattgtaccccataaatatacaaaattatttgtcaattacaataaaacttttttttaaaaa

SEQ ID NO: 1372 - DNA, 953 bp, Homo sapiens
tgggagaaaggggcaggtaacagactggagtgaggagactgaggagaaactgtagagaataatacttaggagtacacgtgctggattctctcattaagttaaagagcaggatgatgtctgaagtggctgaaacacatatggcttcagtgtgtcaagaagacctgaaagatcccacatggaagtgaaattcattactggcaagcacggtggcaggagaccccagagggctgagccgcaaagaatttgcagagccttatggctaactccatggcctagtttgatcttgaagttactgtcttggataatcctctcaaatctgttcctgcacttaagagccactcatcacatgacggagctccctctcaggttcctttacatcgccctgtcagaaatgactttcagggaacagacatcacatcaaatcatccaacagatgtccctttcaaataagttggagcagaaccaactatatggagaagtcataaacaaagaaacagacaacccagtgatttccagcggattgacattactctttgcacagaaacctcagtctcctgggtggaagaacatgagttcaacaaagcgtgtgtgcactatattggctgactcttgccgtgctcaggctcatgctgctgacaggggagagaggggacattttggagtccaaatcttgcatcatttcattgaagtgttcaatgtcatggctgtaagaagtaacccattttaataactggcatcaaaggatttaggagagagaaacccagtatccagacccatttccgtcagtgacactctcctcgtattgggaggattggccagaatcgtctgattcctgtttctgatttccttcctcactggcatcagagtatttcactataggaaaactaatatctaactgagctccaagtgctaaataacagcatctcatgttcattccgggtcaccaagaggtt

SEQ ID NO: 1373 - DNA, 2129 bp, Homo sapiens
ctgcgccctctcggggacgcgaatgccccgcgccgggcgggcgcccgcggagggaggtcccgctccagggacgcggagctccagatgcctgcgcccaaggcccctcgcctggcgccggctggtcccgaacttcggggcatgggcacccaggaagggggctgcgcgtgttgggaggcccgtcctctcgccgcgaacctccggggcagccggggaacccacctgcggagcgggaagcccaggaacgctcgaagagggtgtggcctcaggtaggacgcggcggcgaacccagagcgcgggagaagttgccaagtgtcgctggggccttggccaggagcccctctgcccgaggggcgccgtgctgctcaactctttctctccacctgcttggccccagttcccgcccgcccttcgcctccgggccctggcctggccacagccgcggggacctgcctgcggctccacggcccagtggccgcctcgcggagacccgacctggagaatcagctgagcgccggctgtgtgtaatcacctcgttcactggcatcgcagatgcacgctccagagccgcgggccgactctcccggacctgagcgggccgcgtgtgcccacccacacatcctggagagcccacgcgggagtcggaaaacctgtcaccttggatgatctgtcccatgtggacagggccccaagactgtgctggggtagccccttgcgcaggcaggaaagcgggatttaagggattccagttcccttgtcagcccttgcgcagtcctgagtcctgaggactttctagcctgagagtcctagggcaggagacccgcacccccagagcggctagggcctgtttcggagcccctccgcctgtgattttgtcccagagtcggcatcctctgcttgtcctcagcagtccctgcctaagatcagaatggccattccaaggggctcactcctggctgcccctgtgccatgtttcttttggggtacagggtgttttctatactgggggaagggacaggaatcactcatctcttccccagataaagaagtgagaagacctttgctctccttgtcttgggcccccagagaaaggctgtgttctggctgagtgctgaggaagttctggcttggaaactcagtacatgtggactccaaatggctgccgtcaagtggtggctgggtgactgccagtgtcacagagcggggaccaaggacagtgcagggattttaaaaatcattgttgggcacctcagacttcaatgattaactgaggtcactatggccacttatttttgttcactgattctttagacgcatcaatctactcacggctcaatcttttgcattataggctgtattggtttcacacaatttactctaaggcgcccacctaatagagctcaggcaacccgtgggaacctgacagtcccaaacaggtctgtaccctgtgtggctgcaccacaagcccaatgccctcggctttcctagggaaagcatggtgccaggtgcagatgctggccctctgtgctgtgggacagtggtgtgggagccagccagctaaccataccctgctgccatccccaacatccccaacacatatttatatttagtttctgttctcctccccttactctgtcgcctcctcctcctcctctttgtgtctttcccacgcggattctttctctttcctctgagtggacaatactgtaggcctgacccgcttagacaaactctgacctcctgtggtcacccaggaagctgactgctaggccttggatgagggggcagtgggagggggaccaggtgataccagaatggctccccccacagattcgttacccaaggacatgggtacactggtcgaatgctggctgcagaagcagaatgtgctgcgtggaggtggcagagattggttgctgaggatttgaaatgaaccatgaaccaaagctagaatgaaagcattatattgtctaacctagaatcgacaccctaaattatttttactgattcatgaatgcatatgtgaattattttctttgactacaaatgccttatatacccaaatcacagctccaagcagtacttttgaacagaactacaataaagtatgaatgttagattattaccagaaa

SEQ ID NO: 1374 - DNA, 1704 bp, Homo sapiens
gggactccgcccctcccgatttcctccgggctacaggcgacagagctgagccaagcgtttactgggcagctgttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctgggctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacacacacacacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacggaa

SEQ ID NO: 1375 - DNA, 1519 bp, Homo sapiens
actaggggactccgcccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacacacacacacacacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgactgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctttctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaa

SEQ ID NO: 1376 - DNA, 814 bp, Homo sapiens
ttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctggggtaaggggccatgcggggctctggtctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacac

SEQ ID NO: 1377 - DNA, 1075 bp, Homo sapiens
ccctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtaatcgattccccgtctagttccagctgaaatcatcctttatgtagttgttctatttgtttttagcccagcagtagatttttaagaacagacttttttgccaaaaggcaaatactgcagctacgtgttggtcacagattgaatagagttaaggataaagcattgtgttcatttttaagtatgcaatgaacttgagaaagtagtaactaatcagtctctcatgttcttgaattctttctcatgaggtttggaaaccatgttactgtaacaaaaggaaaaaccatttactcctcagagagattattttctggaactatctcttcatctcttcttacctctgaatttccactgctttacagattttttttttttttttttgagatggaatctcgctctgttgcccaggctggagtgcagtggcacgatctcggctcactgcaatctctgcctcctgggttcaagcaattcttgtgcctcagcttcctgagtagccgggactacaggcgtgtgccacaacacccggctaatttttgtatttttagtagagatggagtttcaccatgttggccaggctggtctcaaacttctgacctca

SEQ ID NO: 1378 - DNA, 557 bp, Homo sapiens
gacagagctgagccaagcgtttactgggcagctgttacgattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccg

SEQ ID NO: 1379 - DNA, 1344 bp, Homo sapiens
ctgtgttcaagctcaggcagagatcagctctgcacacccacaggcacttcaagacctggaggccactcctgggacccaaggtccctccccctcctctcctgtgtcctcaccttgaccccctctgctagactctgtctccctctgggtgtcccactctccacccagaggcagaggaggctgggtggcagggggcaggggctggttgagggccgcccagggccagggtgggctggggggccgttaaaatgtggagctctgcccagccgaggggggctccgtggaggcagacgcagtgtgtgcccagctggggggagtatgggcaggcctgcggccacgtggtaaacgatgaacattcggggcgccccggacctcgggcagcccagtgacgaccccagcagtggtggtgagcgggagcggattcgacagcgcatgaagatggtcatcgggcagcttgagggcatccttcgcgagctcaaggaggtggccaaggagctgagggaggtggtgagccagatcgataagctaacctcggacttcgactttgaactggagccggacgactggaccacggccactgtgagcagcacctctagcagtgacaaggcgggcatgggtggcccctttgacctgggccacctggacttcatgacagccgatatcctctcagacagctgggagttctgctccttcctggacgtctctaccccctcggactccgtggatggtcccgagtcgactcggccaggggctggccctgactaccgcctcatgaatggtggcacgcccatccccaatgggccacgagtggagaccccagactcctccagtgaggaggcctttggtgctggccccacggtgaagagccagctgccccagcggaccccagggacacgggagagggtgcggttcagtgacaaagtgctctaccatgctctgtgctgtgacgatgaggagggggacggtgagcaggaggtggaggaggaagaagtgggcttgccccctgagcctgcccatacagaggcccatgcaggcccccacaagccctccccagccccctacaagtcacggcgctctccactgaccagccgccactcaggctctaccttggcccctgaacagactcgaagggtcacgaggaacagcagcacccagacagtgtcagacaagagcacgcagacggttctgccctacacagccactagacagaaagccagggggaaaaactaggggccggggagggggccgggggcggtgggcacatagagctataaataaatatatatatatatatatatatatatatatttaaacaaatgaagtcataataaaatttaaaaatgctaa

SEQ ID NO: 1380 - DNA, 2204 bp, Homo sapiens
gagccgtgggagcggtctcgcccagggccgaccgcggggctgggctgagcagaccctcgcggccgctccggacgccgcgggtgccggggcacggacgttctgggtccgggctgagcgcgtcccgggcgcccggcggtgccagctcactccgggcggggtagggcagggcagaccccagcggaacacggacccggccgatctggactggacagagcgaatcccggacggtgcagagcccggggaatgccgggcgtgggctgaggggatcccggcgccctcccagccctccgactttggctcacgcgctgggacctgcccggcgtctcctcggcctccccgcgccccggtcacctgtggcctcggagccccaaatctgccggaccctcgctcattcccgaccccgagcctggagaggcttgagaaagatttttcctgcccccttccctggagcgcggaggccccgccccctcccaccgcccagatgtctccggtcacggctcggaggacctccctgaggcccggggccgaagggtccagagagagaagcccgccctagggagccttgggggccccccaactccgtcttggggcttggcccccgacgctgcttggagggaaggccggtgcccccaccctcgggggctgccctcttccaatccagctccctccccagagctgcccatatccggagccccttccacatctggaagaccctggccaccatccctctgcaggtgtcagttgcatccagagacctctgcctttgcaactgcctaggagttgtgaggggatccctgctgccttcccccatcccaagggcatctcttacccttagtccctgcagagtcatccccctgcctctgtgttcaagctcaggcagagatcagctctgcacacccacaggcacttcaagacctggaggccactcctgggacccaaggtccctccccctcctctcctgtgtcctcaccttgaccccctctgctagactctgtctccctctgggtgtcccactctccacccagaggcagaggaggctgggtggcagggggcaggggctggttgagggccgcccagggccagggtgggctggggggccgttaaaatgtggagctctgcccagccgaggggggctccgtggaggcagacgcagtgtgtgcccagctggggggagtatgggcaggcctgcggccacgtggtaaacgatgaacattcggggcgccccggacctcgggcagcccagtgacgaccccagcagtggtggtgagcgggagcggattcgacagcgcatgaagatggtcatcgggcagcttgagggcatccttcgcgagctcaaggaggtggccaaggagctgagggaggtggtgagccagatcgataagctaacctcggacttcgactttgaactggagccggacgactggaccacggccactgtgagcagcacctctagcagtgacaaggcgggcatgggtggcccctttgacctgggccacctggacttcatgacagccgatatcctctcagacagctgggagttctgctccttcctggacgtctctaccccctcggactccgtggatggtcccgagtcgactcggccaggggctggccctgactaccgcctcatgaatggtggcacgcccatccccaatgggccacgagtggagaccccagactcctccagtgaggaggcctttggtgctggccccacggtgaagagccagctgccccagcggaccccagggacacgggagagggtgcggttcagtgacaaagtgctctaccatgctctgtgctgtgacgatgaggagggggacggtgagcaggaggtggaggaggaagaagtgggcttgccccctgagcctgcccatacagaggcccatgcaggcccccacaagccctccccagccccctacaagtcacggcgctctccactgaccagccgccactcaggctctaccttggcccctgaacagactcgaagggtcacgaggaacagcagcacccagacagtgtcagacaagagcacgcagacggttctgccctacacagccactagacagaaagccagggggaaaaactaggggccggggagggggccgggggcggtgggcacatagagctataaataaatatatatatatatatatatatatatatatttaaacaaatgaagtcataataaaatttaaaaatgctaa

SEQ ID NO: 1381 - DNA, 927 bp, Homo sapiens
gccggcagtgcgtgtggtgaggcaggacatggcggaggcaggaaaagtgcccttgagcctcgggcttaccggaggagaagcggcagagtggcctctgcagcggtacgcccgctgcataccctcaaacaccagagacccacctgggccatgcctggaagctgggacagccccctgccccacatggaaggtttttgattccaatgaagaatctggatatcttgttctcaccatagttatatcaggtcatttcttcattttccaaggacagacactactggaagggttttcactcattggtagcaaggactggttgaagattgtaagacgcgtggattgtctgttgtttggaacaacgataaaggacaagagtcgcctgtttcgagtacagttcagtggagagtcaaaggagcaggcgctggaacactgctgcagttgtgttcagaagctggcacaatacataaccgtgcaggtgcctgatggaaacatccaggagcttcagctgattcctggcccacccagggcaactgaaagtcaagggaaggattctgcaaagagtgtcccacggcagcctggatcccaccagcactcagaacaacagcaagtgtgtgtaacagcgggcacaggcgctccagacggaaggacctcactgacgcagttagctcagactcttctggcatcggaggagctgccccatgtctatgaacaatctgcatggggtgcagaagagttaggccccttcctacgtttgtgccttatggatcagaatttcccagcatttgtggaagaggtagaaaaggaactgaaaaagctggcgggtttgagaaattaatgctctatatacatatataactaaggaacttcaaagtattgaaaaatgcttcctcctaaaattaaagaagatattagaataaagagtattatccaaac

SEQ ID NO: 1382 - DNA, 4777 bp, Homo sapiens
tctttatcctcacctgaaactcatagctgtaaaccttgacaatccacaggggtccaaatacctcagccaggtaggaggcctcattgctgagaaagaatagagttcttaagctggtttagttaaatagggattatctgggggcatttactaccaattggtccatactggtaatcctcaaaagggtaccatactccctgtgcccttttccaccaaagatttagaattctattcatgtgagagccctaaggtctttggacatattttaaattctcaagtcattccccccacccccttcatctcatacagatcatctgacaaagtactattcttagaatttgtccctgtttgtggggagcttttctcactctagtcttgctctaaactttaaataatggtcccagacattgtcctgaccatccttccctgtcttgggcaccctcctttcatacctccacccttgacacctttacgcaccaagcaaaaagcacacaagcatacatgatgctagcactcagcattgctagagagatatctggtgtttggggttccattttactcaggccaggcaggcacagggtgtgattctgtccttgaaggattactgggaagggacaacagaagagatgggtattaacaatgagctaggtatttggcaggggcaaaaaaaggtcttagcatggagaatccaggtcctgtcccttacctctctctggaggacggctggacagtgcagagaaagtcagatacatgatatagcagctgatgacagaagcttgtaggaggccagagcggggttgctctggggagtaagtataattgctttagtctacaggctggtaatttcctccatttctacccccacttgtacttctgtctccccatcctttggtggggatagggaagcagagattcttttatcaaataattgagattagggaggtaatgaaacttgctatgcttttaaggcccccaaaacctggaatgctgtaggacatgtacccactgaggcggatgcaaggagcgatggagaggaaggagatgaggccacagaagcaaaggtgcagactgaggagcatcttgttaagcaggcagccagctgggtgtgtataatagtggaataggagcacagctcccacacctgccatgctgtagaatcctagggtggccagcaggacagccaggaaccagctacagtcttgagctgcacctgtctgcctaagggtggaaagtgggcaatggcttggagctccagcattttttttttttttgagttgggagtcttgctctgttgcccaggctggagtgcaatggtgtggtctcagctcactgcaacctccgcctcttgggttcaagtgattctcctacctcagcctcctgagtagctgggattacaggcacctaccaccatgtccagctaacttttatatttttactagagatggggtttcaccatgttggccaggctggtctcaaactcctgacctcatgatccacccacctcggcctcccaaagtgctgggattacaggcatgagccaccgtgcccagctggagctccaactcttttacccattaccaactactcccctgctctcagaagactggtgtgactagccatcctacttggcccacgcagtcatcacattcctaagcttttttgatactgctcagtgggaagctgtgggaccagtgctctgccgtgccttttgcccagccctttccatgtagtaatactagaaacctccccaggaaaagcctttagggttatgtgccccttaccagttcttgttccaggaatgggcaaaagctgtaataagcaccaactgcagtaggatgaatgcaaagcctccacagatgccaatgtaatgccatgctgcaagatgggcaccagtggaaaaatgtcaaattgttacttttttttttttttgagacagagtcttgctctgtcacccaggctagagtgcagtggtgtgatttcagctcactgcaacctctgcctcccgggttcaagtgattcttctgcctccacctcctgagcagctgggattacaggtgcgtgccaccatgcccggctaatattttgtatttttagtagagatggggtttcaccatgttagccaggattgtcttgatctcttgacctcgtgatccgcccgcctcagcctcccaaagtgctgggattacaggcgtgagccactgcacccggccattactcctcttcttacccacttgttatcttagaaaacttagcctactcctgccaagagtgtgggagggagagtacctgggaagagatgctcatcaggaatgcagaaggcaatagcacagagacctaacaggaacagcagcttgaggagccagaagctggttaggagggagaaagaaaaacagactcaggagaaaaggcaaaggacagtgaagagtgcctatggggaaaggcaaaagagaaaccaaaaatataggaaagaggacagacgagacaactaaggaggaaccaatcccaaatgagagggggttgggacaggcctactgcaccttattccaaattctaactcaaagatacttaatagcatctgggcaatgttttacagtttataaaggattgtgttaccaagataaccccactgttacctccattttagatgctagaagcacaaagtctggctcaaggttacacagcaagtacacgagaagcagggacttaaacctgttttctgtctttttacagtgctattacttcatcccggaatttcctttacccagcctatgtctactttccctcctctgtcccctccccacccagaaagtacacacaaacctattatgcagctgtgcccgcgggctggtgggggagtggaggtggaccagcaacacagcctgcagcaggtggaaggtggcggttcctgcacatactcggtacacagccccagagccactgagcactggacagtcagagaggccaaacaggtgggcacacaaccccgagggcatctggatctgggagtgtgtgtgagagaaatggcaggacaagtcataatgcatggaaaggtacctacttgtcacgggtatgaccactcatttgtctcctgcccccaaccgaaaccttttctatcttagggtttttccttttatctcttcccacctgacaacccgaccccctctcacttaccctgtgtgtcttgccccacaccctttccactactgtccttgacagcaggaggcagcagattgctgaggcccccacatggaggaggatgtagaacaggcggctgcaagtggatgcggtgagagagggccacctagagtggcagcagctggcacaaggagcaggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcgcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatc

SEQ ID NO: 1383 - DNA, 1051 bp, Homo sapiens
agaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctggg

SEQ ID NO: 1384 - DNA, 2216 bp, Homo sapiens
gggacgcgggcggcggcggaggctgcgggagtcgctgccgctcgagggaccgcggacccgggaggtccggctcccggcgccgggcctcagtttcccccacgggagccgcatcccacccccagagccccagcgcgtccgcggggtccgagtcgcggccggcgcggggcggggaggggcgggaagtttgcgccctacacgcggcctcgcagacttggcggctccgctcccggccgggcgcaggtggccatggtgcccggccctgcctcatagcaggctgccatgtcgcgggaggcgggctcatgccgcgtgggcacaggggcgagggcgcggtctcggaagcccaagaagccacactacatcccgcggccctggggcaaaccctacaactacaaatgcttccagtgccccttcacctgcctggagaagtcacacctctacaaccacatgaagtacagcctctgcaaggactccctgtccctgctgctagactccccagactgggcgtgccgccgtggctccaccacgcctaggccccacgcacccaccccagaccgccctggggagtccgaccccggcaggcaaccccagggagcacggcccacaggtgctgcccccgcgcctgacctcgtggtcgccgacatccactccctgcactgtggcggaggccccaagtccagggccaaggggtccccagggccaccaccccctgtggctagggccacccggaagggtcccggccccagtgggctcctgcctgagtcgtggaagccggggatgggaggggacccaaggggcgtgggtgcgggggacatggcctcagcaggccctgagggcagcgtcccctgctatcccccgcctgccccaggggagttccctgaggcccacagcctccacctgtctctgctgggcgtcaactacccgctcagccccggcctcttctcctacttggggccctcactggccgctgcagcccatgtgcccttcctggcctcggccagccccctgctgcccccggccacggccttcccagccgtgcagccccctcagcgccccaccccggccccccgcctgtactacccgctgcttctggagcacactctggggctgccagcaggcaaagctgcccttgccaaggcccctgtctcccccaggagcccctctgggactccggctcctggcctgctgaaggtgccagttccagggctggggccctggccccgagtcacccccagggacccagggcaggagggggagctggagcgggcagcccagagtgaccccaggaggaggctgtccctgggaagcaggctggagcttccgaaggcatcccccagcctgacaaggttctgttcccggagcagcctgcccaccggctcctctgtgatgctgtggcctgaggacggggatccaggcggccctgagacccccggccctgagggccccctccccctgcagccacggggcccagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccagacccctgaggctgtctgtggcctgcagagcccccagggcgccgaggtctgacctgcagcgcctgaggtctgactgtctctgcctgcagcatgccggcccctctcctgcagcccctgcccctcacctgcctgggacctgccccgcctccgcatgcatgtggatagacccccacgggccgtggccaacgcttgtccctggggccacacagggacactggaggtcacagttatttattgatcacaattgtggacattaaaacagaaactgttcac

SEQ ID NO: 1385 - DNA, 840 bp, Homo sapiens
ccaccgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacgggccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggc

SEQ ID NO: 1386 - DNA, 549 bp, Homo sapiens
ccaccgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggc

SEQ ID NO: 1387 - DNA, 609 bp, Homo sapiens
ccaccgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggc

SEQ ID NO: 1388 - DNA, 712 bp, Homo sapiens
ccaccgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggc

SEQ ID NO: 1389 - DNA, 772 bp, Homo sapiens
ccaccgcccccgacgcgacccgcgccgcgtccgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggggctcttcagagcagcaggacacctgctcaaacccagggccctgctcatcacctacggggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggc

SEQ ID NO: 1390 - DNA, 1243 bp, Homo sapiens
ggaccggaagtggcgtccggcgcaagcgctggcagccgcacagcccattgggaggccgaggggcgcggccgtggggtggggagtccccggcaccccaggtccgcgccatgggccgcaggagggcagcgcgcgggccgggggcggaaggcggccgccctcggcacctcccgacgcgctccctggaggccttcgccgaggaggtcggcgccgcgctgcaggcttccgtggagccaggggcggctgacggcgagggcggcccgggcccggcggcgctgccctgcacgctggccatgtgggagttgggccactgcgacccccggcgctgcacgggccgcaagctggcccgcctggggctggtgcgctgcctgcgcctgggccacagattcggcggtctggtgctgagccccgtgggcaagcagtacgcgtcccccgcagacagacagctggtggcgcagtctggggtcgccgtcatcgactgctcctgggccaggctggacgagacaccgtttgggaagatgcgagggagccacttgcgcctgttgccctacctggtggccgccaaccccgtgaactatggccggccctacagactttcctgcgtggaagcgtttgctgccaccttctgcatcgtaggctttccagaccttgctgtcattttgctgcggaagtttaaatggggcaagggcttcttggacctgaaccgccagctcctggacaagtacgcggcctgcggcagcccggaggaggtgctgcaggcggagcaggagttcttggccaatgccaaggagagcccccaggaggaggagatcgatcccttcgatgtggattcagggagagagtttggaaaccccaacaggcctgtggccagcacccggctgccctcggacactgatgacagtgatgcgtctgaggacccagggcctggcgccgagcgcggaggagccagcagcagctgctgtgaagaggagcagacgcagggacggggggctgaggccagggccccggctgaggtttggaaaggaatcaagaaacggcagagagactgagggttgcagacacatatatttttgaggctgggtgacgagaaaatctagagacatgagggacataaatgggcctggcagcctcggctctttgcggctgctggcaggactgagctgtccgggttctccccacacttccagcacagctgtgctctgtgtcctgcctcggcgctctcgcaaatgaagctgcaggccaagaa

SEQ ID NO: 1391 - DNA, 2231 bp, Homo sapiens
gtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatca

SEQ ID NO: 1392 - DNA, 2050 bp, Homo sapiens
taacaatcatagccaggatgtgaagcctgtcagtttcctcagccgcaaattcttccatgtggggcgacctcacagagacgggatgtatgggacggcggagtgcaaagaaagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatca

SEQ ID NO: 1393 - DNA, 1553 bp, Homo sapiens
agtagctcttgccagtaggccgggactagctgtctcggggccttccatccgcttggccccacaggaaaagaccccaatattctcttttagtagcggagcgtgttgatcctgcctgaagtacaccagtgttccgaaggtgcatctggtgatctgcaagaagatgttaaaaactttaagcaagcatcacagtaatggatctctgtcagaaaaatgagactgacttagaaaatgctgaaaataatgaaattcagttcacagaagaaacagaaccaacctatacttgtccagatggaaaaagtgaaaaaaatcatgtttattgtcttctcgatgtcagtgacattacgcttgaacaagatgaaaaagccaaagagtttattattggaactggatgggaagaggcagtccaagggtggggaaggacttctccagctgcctgcatctggccgaggaagataccaaaaaaggcgagggtaggggaaggtgcctgcagcgactgcttggtgtgtgttaacctctcccactggagcctccagaccaagcctcctactgaggggggcccagagaaggatcagagcagcccctcccagactcaggcagccccccagggccccagcactgcttccagggcaattagcgacatctgctttcccacctactttcgagcagagaaaaaaagtctgcaaatcaaggagtttatttggtgcaacaaagactgggccatccccggcactaataggggcaaggcctctgggaatcccagtggaggggcccacagagggctgtccatcccaggccccctgacttccagggccctcctagttctgcctcccctgaaggcttcactttcaaatgctttggatgttctgggtaagaagagtaagaactctttcttgcagtcagaagagaaggtgctggatgtggaaaaggatgggtgtgtggcttatgcatatggcttgaaaacagcagatgggaaaggtgaaaaaagagccagtgagctggccaaacaccctatggtcaacgacacgccatcctccccttccccagcggcccagatatccctgctgaccgatccggagcagcgctgcctgcattggtccctcctgtctgagaaaaacctggcgtgccctccagaccccagcaacgttcgctaccttgctgccttgcagcttctgcagaaacggggagtgcaaagctacaaatccaaattcaaagccaaggagccaagatctcctgtgatcacccgaaagcatgttctcccaaaggccaagcaggaaaacaggccccaaatgctggagaccaaagttttcccaagacctgtcttgccgtctctcacagtgagcagagttatcattcctgtctctacccacaggatcctctgagcggttgcggtagaacccctgggaataagcaccgtttgagatgcagccatcctttctctttcttctctctcatttcccacccaccccccactctctctttctctcctccccgtcagtctgtctttactcttcttttcctccattttttttttgtagtacaactgaagaaaactg

SEQ ID NO: 1394 - DNA, 1857 bp, Homo sapiens
ccggcagcgacctgagtagctcttgccagtaggccgggactagctgtctcggggccttccatccgcttggccccacagcaagaagatgttaaaaactttaagcaagcatcacagtaatggatctctgtcagaaaaatgagactgacttagaaaatgctgaaaataatgaaattcagttcacagaagaaacagaaccaacctatacttgtccagatggaaaaagtgaaaaaaatcatgtttattgtcttctcgatgtcagtgacattacgcttgaacaagatgaaaaagccaaagagtttattattggaactggatgggaagaggcagtccaagggtggggaaggacttctccagctgcctgcatctggccgaggaagataccaaaaaaggcgagggtaggggaaggtgcctgcagcgactgcttggtgtgtgttaacctctcccactggagcctccagaccaagcctcctactgaggggggcccagagaaggatcagagcagcccctcccagactcaggcagccccccagggccccagcactgcttccagggcaattagcgacatctgctttcccacctactttcgagcagagaaaaaaagtctgcaaatcaaggagtttatttggtgcaacaaagactgggccatccccggcactaataggggcaaggcctctgggaatcccagtggaggggcccacagagggctgtccatcccaggccccctgacttccagggccctcctagttctgcctcccctgaaggcttcactttcaaatgctttggatgttctgggtaagaagagtaagaactctttcttgcagtcagaagagaaggtgctggatgtggaaaaggatgggtgtgtggcttatgcatatggcttgaaaacagcagatgggaaaggtgaaaaaagagccagtgagctggccaaacaccctatggtcaacgacacgccatcctccccttccccagcggcccagatatccctgctgaccgatccggagcagcgctgcctgcattggtccctcctgtctgagaaaaacctggcgtgccctccagaccccagcaacgttcgctaccttgctgccttgcagcttctgcagaaacggggagtgcaaagctacaaatccaaattcaaagccaaggagccaagatctcctgtgatcacccgaaagcatgttctcccaaaggccaagcaggaaaacaggccccaaatgctggagaccaaagttttcccaagacctgtcttgccgtctctcacacacaggaaaaagaagataaagtaggagagggatcagtttcacattcagtcctaagcagcaacacggttgagatgtaatcataaaagcaaatatttcacccaggacatggaaaagcggcggatcaccagaaagcagagagtcaaacgctgcaagcagaagcagtaagaagacgccacgtttggagcaaggtcttatttacacctgccatggtcatcggctcgctcttttaggtctccccaacccggcccccaaaaagaggttatatgcagaggtaatataatatatgtacttttgaaaataacaaagtcaccgtggagataatttcaaaacaatttattttcattttcagatacattggactatttcactgatgttaaaaagagtatgacttgtttaaattttttgttgtttcttttttgcagcctaatgttctgtaatagtaacttgcttccaagtaaagtatgaaaagttagtggaggggccatggctgtggtctctgataggtcaaactatactattttggaatgcgtggagttagaacaaagtttttattttgttattaattagtaaagcaataaataaaattgtcttactaata

SEQ ID NO: 1395 - DNA, 1341 bp, Homo sapiens
agtagctcttgccagtaggccgggactagctgtctcggggccttccatccgcttggccccacaggtccaagggtggggaaggacttctccagctgcctgcatctggccgaggaagataccaaaaaaggcgagggtaggggaaggtgcctgcagcgactgcttggtgtgtgttaacctctcccactggagcctccagaccaagcctcctactgaggggggcccagagaaggatcagagcagcccctcccagactcaggcagccccccagggccccagcactgcttccagggcaattagcgacatctgctttcccacctactttcgagcagagaaaaaaagtctgcaaatcaaggagtttatttggtgcaacaaagactgggccatccccggcactaataggggcaaggcctctgggaatcccagtggaggggcccacagagggctgtccatcccaggccccctgacttccagggccctcctagttctgcctcccctgaaggcttcactttcaaatgctttggatgttctgggtaagaagagtaagaactctttcttgcagtcagaagagaaggtgctggatgtggaaaaggatgggtgtgtggcttatgcatatggcttgaaaacagcagatgggaaaggtgaaaaaagagccagtgagctggccaaacaccctatggtcaacgacacgccatcctccccttccccagcggcccagatatccctgctgaccgatccggagcagcgctgcctgcattggtccctcctgtctgagaaaaacctggcgtgccctccagaccccagcaacgttcgctaccttgctgccttgcagcttctgcagaaacggggagtgcaaagctacaaatccaaattcaaagccaaggagccaagatctcctgtgatcacccgaaagcatgttctcccaaaggccaagcaggaaaacaggccccaaatgctggagaccaaagttttcccaagacctgtcttgccgtctctcacagtgagcagagttatcattcctgtctctacccacaggatcctctgagcggttgcggtagaacccctgggaataagcaccgtttgagatgcagccatcctttctctttcttctctctcatttcccacccaccccccactctctctttctctcctccccgtcagtctgtctttactcttcttttcctccattttttttttgtagtacaactgaagaaaactgaacctcagtggattgttgggatttattttctaaaacaccatattcatgtgttaacgtgcttctgctacttagccattcacaaaatgccaattggtcttgccagccccagcctctgcctgcttcat

SEQ ID NO: 1396 - DNA, 4360 bp, Homo sapiens
gggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcgggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaatgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaaaaaaatcaaacactaagacacatgttttgggtgggtgggtgggggaaatcttccttatatttatataaatatatataatatatatattttgctgatgcagtatacagtgtgtatatatgtgtgtgtgtgtgtgtgtgtatgtgtgtgtaaatttatatacacacacatgcaaacagttcctggaagagaattctgaatgctttgctagcaaaacactgtggtgtgcaaacctagaacccaatagaaaaaaaagccatttatctgaaggctgcatagtggagagagtcttcagtttacctcattctttgtagcagcccttgattttaacaggtttttgtaataggtacagataatcccatacctttctaggtgcgattttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaagttcgctagtaaatatctggctattttggctatttacaacactaatttcattatttttatctgtaagcattattaatacatctttaccaaaacctgagcaatacaatattttctttatatgttatatgcctttgtttgctaaaagctaatatttttgcatttactttaaagggctgtactaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctattacccaaaccattaaattgtctttaatttcattgttgtcttggaggtccagtgcatacagggctgatgggggaaaactccctctagccagtcagcactctaacccaggattaaaccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattggaaactaactttgcatatgctgttagctattattttgcatcatgggcttcatgggaagaacatgttgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagattttgaagtttgtgatcaaggtctgtatattatcccaaactttattaagaattgttttctaattggttataacatttttcaattaatagtttcaaaacaaattgttaatacaactgtataaaatgaacataattttcctcacttgtatttttgttattgagcaagtttatcaaaataaattgtctactaaa

SEQ ID NO: 1397 - DNA, 2248 bp, Homo sapiens
aggatggtggccggtcccgccagaggggcggggcgcggctgcgcggcgcgcggtcgccatggtgacgcacgccgctggcgcgaggaccttttgtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccaccgcccccttctccagtgctctcggggagggtgcaccagggctgccccacgctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttggaagtggctggctctgcagagtgatggacagcaggtggcatcttacattgtgatttgtggtgcacagttaaaacacttcccttcgtttcagaaggagacaatgtgaatacttggaaattatagtgaataagatgcctcccaaacttgaggaaaaggtcagattctaagagctaaacgttaagatgtaatgttccagaacaaagaggcccagagtcactgaacggggccccagggctcctagcttgagtgtaatctgagtcagcttatgaaaaggccccaaagaagaaagtggaatgtgtgctgggcacatgggacagccatggcactgagactttggaagtggccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgcc

SEQ ID NO: 1398 - DNA, 1297 bp, Homo sapiens
gagtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccaccgcccccttctccagtgctctcggggagggtgcaccagggctgccccacgctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcacca

SEQ ID NO: 1399 - DNA, 1656 bp, Homo sapiens
tcccggaaggggcgtggctcttcagaggcggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 1400 - DNA, 947 bp, Homo sapiens
cgaaggtcgccgagccccccacgccgctcttcttagaagtgtgcaaccttgcaccagtagtggacttacacataggctccgttaggacctggcttatgtgctcggcttgtggcttagacgctgccgtgccccagtggactcactgtgcctccccccacgacggacggaaatgggcccctccaggacaggcggcgcatgcgccttggggcccgcgggcggcgggggcgaggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 1401 - DNA, 2788 bp, Homo sapiens
atgaggtccagctcgtccctggctctctctctctctcaggtcctgatgtcttttccaagtctggagagcagcgatgctgctgtgccctgcgcagaaaaccgtgttccggctgcagctaaccaccgcagctcaatgtctctgggtgtatctcagagataagcaggtggtggtgttccttgcttatcccacaagggcacctggccggaataatggagtcacttccctccactggcctgaccccactctttctctttcctggacacaggaggcatacacggaatacctgaggagcatccactatatctcccaggtgttactagaagaagtggaaaccactaaagaagctggggaaactgtgccccccgacacctccaagatgctgaagctagcacagcagtgtctggagagggcccagtcgacggccgccaagcttgggaaaacacgcctgaagccaaccatgcctgcagctgctcccattccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggcccgtggggtctccctcacccctgggggacaccgcatctggattgccagacaaggacagctcgttcgaggacctggagcagttcctggggacgtctgagcggcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccgggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttactcaccttggctgtgggctgtgaacattccgggaccctgggcatcttatctaggtccgtgcagcccaagggtcagccctcttgactgtcacatgctgcccccacccagcctaaaataaagagctcactgctgtg

SEQ ID NO: 1402 - DNA, 2749 bp, Homo sapiens
gcggccgcgtcccttcctgcggtccgctgctcgggcggctccagcaccagcgccggctgcgttccgggcctccggtcgcccgtccagcccctcggctaccgccgccgcctcccccgctcggcgccatggccgctgcggccggggacggcacggtgaagccgctgcagagcgccatgaagcttgccaacggggccatcgagctggacaccggcaaccggccccgggaggcatacacggaatacctgaggagcatccactatatctcccaggtgttactagaagaagtggaaaccactaaagaagctggggaaactgtgccccccgacacctccaagatgctgaagctagcacagcagtgtctggagagggcccagtcgacggccgccaagcttgggaaaacacgcctgaagccaaccatgcctgcagctgctcccattccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggccccgtggggtctccctcacccctgggggacaccgcatctggattgccagacaaggacagctcgttcgaggacctggagcagttcctggggacgtctgagcggcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccgggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttactcaccttggctgtgggctgtgaacattccgggaccctgggcatcttatctaggtccgtgcagcccaagggtcagccctcttgactgtcacatgctgcccccacccagcctaaaataaagagctcactgctgtgc

SEQ ID NO: 1403 - DNA, 2722 bp, Homo sapiens
agttgcgggagggcgcggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggagtgacgcgctggaggctgtttatagcgctgtcaggacagcgcggggagtggaggcagaggcctgagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttgtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccagcaacttgaagcgtgggatttggatgacatccttcagagtctggcgggacaagaagacaaccagggaaatcgtgcacctggaactgtgtggtgggcagctgaccaccgccaagttcaagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcagatgtgcctcaaggaagcagggctcccaggctgggccaggcccgcagctggcccagggcatgaggcttaacgcagagtcccccaccatctttattgacctgcggcagatggagctaccagaccacctgtccccagaaagctccagccacagctcctctgacagtgaggaggaggaggaggaagagatggcagctctgggagacgcagagggggcatctccttcctccctggggctacggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctcactgagaatgttttacagtgatggaaaataaactctgttccaagttcaa

SEQ ID NO: 1404 - DNA, 1733 bp, Homo sapiens
agtaatgtaaagctccggccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccagcaacttgaagcgtgggatttggatgacatccttcagagtctggcgggacaagaagacaaccagggaaatcgtgcacctggaactgtgtggtgggcagctgaccaccgccaagttcaagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcagatgtgcctcaaggaagcagggctcccaggctgggccaggcccgcagctggcccagggcatgaggcttaacgcagagtcccccaccatctttattgacctgcggcagatggagctaccagaccacctgtccccagaaagctccagccacagctcctctgacagtgaggaggaggaggaggaagagatggcagctctgggagacgcagagggggcatctccttcctccctggggctacggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctcactgagaatgttttacagtgatggaaaataaactctgttccaagttc

SEQ ID NO: 1405 - DNA, 5983 bp, Homo sapiens
tcggcggtggcgacgacgacgacgttgctcagtcttggggtgggctccgcggtgcaggccgagctgcgcggagggctcggcgatcagcggcggcggcggcagtggggaggccgcagcgccatgggggggcgttagacaggctgcggcggccgaggcgaggggcggcagcggttatctggtccgcggcgaccttcggccgggcccgggggtgggaaggcctggggcgggggtcgtccctggttgcacggggccgcggggcggggctcgccggccgtcggggtgcaggaggcctgggccgctgaaaggagaaggcgccgtcggtcgccaggccctgccgccgggccgcttgacgacgacgctcccgcgggggccccgcctgaggaggacgcggcggcggtggcggcgaggccgcgggaggccgcggaggatggaggagcggaaggaggagggcgaggccgagatccaggagcacgggcccgagcactggttctccaagtgggagcggcagtgcctggccgaggccgaacaggacgagcagctgccccccgagctgcaggaggaggcggcggccgccgcgcagcccgagcacaagcagcagaagctgtggcacctcttccagaactcggccaccgccgtggcccagctctacaaagaccgagtgtgtcagcagccaggactttctctctgggtccccttccaaaacgcagccaccgccgtcaccaatctctacaaagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtcttagtggtgcaatggctagtataagcgtgcgttcgagtaccccaggctctcctacacatgtaagcagtggatcgaatgctagtcgaaggagaaatggactccatgatgtcgatttgaacactttcatatcagaagaaatggcactccacttggacaatggtggaactagaaagcgtacctcagcccagtgtggcgatgtcattacagactcaccaacccataaacgcaacagaatgatctaaactgcaaacattttcacacccaccatgctgcttgaaagccacttgatcctcaacatatactataattgcaaaggaaacatgaggccatcttcccttgttcactgtttaagacaagtgaattctatagtggttgccataaaaggaagttctaggtatttatagtagatgcctcttgtaattatggctttcttaaaactataatcctagcagaggacatcagatattgtgtagtcgttagcaagatcatcataggcaaacatatatccgttccaaggctaaaagtgaccttaactgtatttattctcaaagggaaaggaaatatcagatgtttatttggttatagaatgctttttttttttttgggtccatttcctgctgtgttgagtattttgcttcaacagtattgccaggttcctaaaattgtctaaaaacatgatttggcttccatttttgcagctgcactgtaccatgcacctggtttctatatagtaacagtgtgcaattctaattattggactgtgccctgtttttagttttcaaatcaatttctaattctggtgattgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaacatgtagactgcattcgaggtgacctaaagtagagaggtcatgaactttgagaatgggcttcctttttggttcagtattagtgagagggagagggagatggatggtggggtaggttttctagtctatcattttacatttttcatggagtccctgcttagtgcagtttccattggaatgggtggaagatgataaagctctcttttttatctactaataatgtgattgcaacttaaaatagcaaaacccaactctccctgtccctccaatccctctcctaaaaagttcagtttggaatctcattctggaaaagatggaatcgcatggagattctctagctgttaggtagacctaaataaaaagttctcaatagattcctcttttgagtaaatataagacctcttgtagctacaatgttttagagcatgtttcatcttcatttttaatatcctgaactgaatgatagtgtttttttagatgaagaactgatgtcagcctgccaggtactgtaatttattctatcatattattatattatatatcaagtaggacagtgaaaaatgtttccttgcaaacttgtagtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaactttagcatttgttacttttttccattgcgtttactttcaaatgcacctaatgaatttgtcacccagtcgcaacttttcccttctctgtcccattgctttctcctttccccgacgcacagaataaacatgaagctcagcagtagaagcgtaatgatttccctcaggaaaaacttctgacagctaggtttttcaagggtttccctgtgctagctgagatgcaaaacaaatcatggaagattgcatacctgtgtggtattttaaaaacaagttgactttttcagtttcttgaacggttaagggtggatttaaaaactagacagtttagttttggggaacagaagctctcttcgtcttaagccagattctctgattcttttagacgtcatagctccttagttctgctcctgtcgccctaacttggcatgggcaagttgaagttcatccttagactgcagcgttctgagcatggctgaagtattaaaatgtttaatattttttagagcaaaattgttggaaagcatttggctgaatctaaagacctgcagtcagattcttcaatgtggtttacccaactggagtagtgataaacaccttaatcataaaatgaataaaaacaaaaaaaccatggggcttgtctgcagttttgttttggtcatcacatctgaataactttttgatgcaatcaaatgaagtttaggcttttaaaaaagaattagctttctaaatgtttttttctaagggctactggaactcattaaactcgaataattgtggctttgggcctgaagatttccattcaacagtgaaaactggctaacttcctttatagtgagagggatggccaacatccaacccagagggctagtcagcctcagaggccagtgcaagacgccaagagatgattttgaaatggggccataagtttagaaaattatgaacagaatgattgagtttttggcctggctactacctctagtggtgactacgtcagcagattaatctcattgcattttactttatgtagtatgttgtaacctggtgcttcattcattagattggtgactgaggtatttagtcatggtgaggatgggaatcttcagagatacattctggatttgtggaataaagtgactagaaaggttcttccagagcaaccccttgtttaaagttataagtgtttatggtacctgctaccccttctggaaagttgtcggctttgatggtttagatgaccttaccccataaggccagcttctagcctccctttggaatatttgaggtgtgtgatgttttagtgggggcagcatttgagagacgagcaggcccgagcacccaggctggctgtcagaccgtgtgttgtgctgttgggtttgatgggatgagatatccagggttttacttcctataatgggatctgcaggctccttgtgaagttcagttagacagtagcctgtgacgtagcaagtcaagttttcgatggcccctcattttttttttatttagtgcttaaaaaaaagatttaaaacagcaaaaatcaagccacacagcagcttatagtatatacaggtcttttatacattagaagtaatatggtgaaatcttttttttttttttttttttttgtgatggagtttcactctctcacccaggctggagtgcagtggcacgatcttggctcaccacaacctctgcctcctgggttcaagcaattttcatgcctcagcctcccgagtagctggtattacaggtgcctgccaccacacctggctattttttgtatttttgttagatacggggtttcaaatatggtgaaatcttgtgacagaatagtattcccttgtacagataagccttgatgcaggttacagattttttataattagtaatgcagcagtggagtgttttctttttcttgttttttgagatggagtctctgtcgctggagtgcggtggtgcgatcccagctcaccgcaatctctgcctcccgggttcaagcgattctcctgcctataactacaggtgtgcgccaccacgcccagctaatttaattttgaatttttagtagagacgggatttcaccatgttggccaggccagtcttgaattcctgaccttaagtgatctgcccgccttggcctccccaagtgctgggattacaggcatgagacactgcgcctggcctatgttttaagtttctctatgacaaatttctgtagatgaactatctgggtcaaaaaaattcatctataaaatactgatgggtcttgccaaagtaccttctgcaaggtaccagttaatacttccatcagaaagtaagagcgcctgttcccttacatcgtagccagtgttgggtatttatacttcctttggcagaagtgacctttcagttttaatctgttttttacctgctcgtatgaaggaagactttttgcttgatatcacgtgggtttgaatgctgactctactaccaggtctgggaacctaggtaagtttgcctctctgggctgttttctcatctgtgaaataaatagaaaacatagaaaaataaattaaaaaatgtgaatgtta

SEQ ID NO: 1406 - DNA, 1068 bp, Homo sapiens
catctggaggccacaccctaccttctaagtcaccaggccatcaagtccagacaaagggatcgaaagagtgagacagtgccagccacctcccacccaagccactagcaagactccacaatgtcagagcaacaaatggacctgaaggatttaatgcccacaaagaggaaatacatgtggaagactgctgaagataggcgcatgtctgacctcacctgtgtgctggagtggctggagcggaggcaggggaagaagaaacaagctcccgagaagcaaaagcccaaagtggtgacagtccttaaacgaaataagaagaaggaagagaagaaaggcaaaggcctcatgacagcacggggagggaaccgcagggacacggagacttcccagcaggccttaggaaagagattcaggaaggacgccgcctcctaccgaagcctctatggagtggagcaaaaggggaaacacctcagcatggtccctggcagctacatcaaggatggccccaagaaatctgatacagacatcaaggatgcagtcgacccagagtccactcagcggccaaacccattccgtcgacaaagcattgtcttagatcccatgttacaggagggtacctttaacagccagagggcaaccttcataagagactggtccaacaagatgcctgacatggcttacgaacgcaagctaaagagcctcatggagaaaagcaccgaacctaagatggaaaccatgaggatgttgaagccagaggaggtgctgagctgccgatacctgaggttatccaaggagaacattcggaccttgctcaagttgtgcaaggatgcaggaatgaatgtggatatccacccccacatggtcgaagaggacatagatgctaaaaaggtgttcaccggaatacccagcatggccctctaaatagctcctctcgccaccaccttcaggctccttctgtcatgggacccttcacctccagatgccatcctctggcacactacaagtggtccttccaacttagtgcatccctttagaaagtaagcaatcagaaaacaagcctcggctgtgtgatca

SEQ ID NO: 1407 - DNA, 1279 bp, Homo sapiens
gcgggggctgggaagtggctgggggtgcacagtcccacacctgtcattcactgaacaggcacgtattgacagcttgtggcgtgtcaggccctgtgcccaactctgggagtcaaggataacctgacagactcaggccactttaggaaaacgaaatccaccccaaccacacttagcgagtcaccctggccgggcctgggctgccctccagtcggtcagccggactggatttccacgcggccgagccctacgcctcccagaccctgagctccagtctgcacaggccaggtgtctggagccgggcctggtgacaggcatcccccaggtgggaggaggggctgtcctggctctgacctggatatcagatccagagctgagggggaggcgcagggtcaggaggggaggggttctgttctgagtttcccctggccaaggctgcagacaagggacgcagacaatcggcacattgtgagcaggggctgcaggatggaaccagcaagctgctgtgctgagcgccccaaacctgggcctacaggggtgaagaccaagccctcctgcgggggctggagagccgtgagcctgctcctgctgctgctgctgctggtgctggccgctgtgggggttgtggctggagggcttcttggctctgctcagggccctcccaagccaaggctgcagacgctgcgaatgaccctcccgagcccccacatgccccggcccaaccaaaccatcctggtggacgtggcccggaacgcggcgaccatcacagtgaccccacctcagagcaaccacagctgggcggtgctgttcgacgggcagagcggctgcatctgttaccgccctgaggagcaccaggtctgcttcctccgcctgatggaggacagtgatcgggagaccctgcggctgctggtggatacctccaaggtccaagaggcttgggtccccagccaggacacccaccacacccaggagctgctggcagtgcaggggagcctcgaagtggaccccgcccaggcgggggctttggtgcagcgcctgtgcatgaggacccccatctactgggcccggcgagcagaggggccccggagacagcggctgatttatctctgcatcgacatctgcttcccgagcaacatctgcgtgtcggtctgcttttattacctcccagactgagcccccgacctggcccagcctggcccgtccccaatccagtgggctggccaggccacctgcaccagggaggacagctgctggcagggactaataaacccttccacctggc

SEQ ID NO: 1408 - DNA, 1325 bp, Homo sapiens
ggagggattcattttaagcaacgggcggccctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaatttg

SEQ ID NO: 1409 - DNA, 3186 bp, Homo sapiens
atccccggggatgatcgagttcatcaaagtggaaaacttaaggcggtcttcgtcgggctgatacttcctgctttattgaatgttgatattaaatgcttacctccggaattattttttgaggtatcgactttagattaaaagcctaacaattcttacctttcccgtgggctgcctggctccccgcgcggttcaacgcgagcagcgccagtgaggggacctgtcgcgtgtcctgctcagcgcggtgtcccacgggcgcgtccacagcccggggcgtccaggggctgcagcggtgcgagctgctctagagacggagggcccggccggagaccaggggccggcggtttcatcctgcgctgacccttgccaacgacgtggctggtcctggggatcacagggcttcgctcatcccatcttcctccatatccccaaggtggaaacaagggggcgagatgtccacaaactgaggaacagacaaaatgctggctgtccatgcagtggagtgtgagtcagtcatcaagaagagtgaagttcagacccatgccacaacatgggtgaaccttggaaacatactaagtaaagcaagccaatcgcaaaaggacaaaacctgtgcgactccatgctatggaccgagttctgtccccctaacatttgtatgtgaagccttaatccccaatgtgactgtgtttgcagaaagggcctttagagaagtaattaaggttaaatgagattataagggtggggtcctgatctgataggattagtgtccttggaagaggtaccacaggcctggcactgtggctcacacctgtaatcctagcactttgggagtccaaggtgggaggaccacctcctccaggagtttgagaccagcctgggcaacaaagcaagacccctgtctctacaaaaaaattaacagggcaccgtggtgcgtgcctgtagtcccagcaacttgttatggttacgtaagaggaatgtgaattcaaccctggtgattttgggtcgtgtcaggagcagccctgcgacaccagttggcaccttctgcagactctatgtgtcgataagacaaggtcccacccagcaagtgcccttttctcagctgatgaacataagcctgcatggacgttactgtccatggaaaggagcggccggcaccggctgtgacagacacgtgcctgtctgcgatctgagtttcatgaacagtaaactctgttggtcacagcctctttggaaaacaatgttagttaaaagaagtgccctgtgaccagcagtgccaccctcgacagggttctccaagtgggacccgggcaagcagcctcagtatcactaggggttgttagcaatgtgccttcctgggctctgccccagagtggccgcaccagtgactgggagtgaggtcccagggccctgtggtccatgaagagctctcaggggattctgatgcccagtggtacaggtgggccaccggactggggtgtcatctgcccgtgggcatgagacatgaacaaggacatagcaggtctgttagtagtcataactaaaagaacaaaggagccgggcacggtggctcatgcctgtaatcccagcactttgggattacaggcgtgagccactgcgcccggtccacgtttctatcaaattgaaatcatgagcggttttgctgagggtgtggggcacccagagcctgcggcctgtgctcgagtgaaaatggtggccccgctccagaagcctgcgacggcgctcacggaaccgcagccttcgtgcggcggcacctgggccgtgctactcctctgtgacttcccggaagagatgagctgctacgtccagcaaaaggcacatccaagatcgttcaccccagcatgactcgttacactccggactagaaggaaccccaaggtgcttcagtgacagaacgatgaaccagctggggtgtaacccccatgcaatggaatatcgtacaggaacgaaaaggacacgctacccctacaagcaacatggatctcagaggcaggatgttgcgcagaagaaaccagacacaaatgcttcggctcgtgttgctgcgactcattacaggcagccgaatctgcggtgatgggggccccaggagcagtgaccaggaggcagtgccacggagcctgcggtgggggctgatagtcagtagcgtgacctggttgggatgttctgtttttaagctggagtccatcatgtttgtttatttgttcatttcgtagaggtgggggtcttgtagaggtgggggtctcactctgttgcccaggctggtctcaaactctgggcctcaagcgatcctcccaccttggccttccaaagtgctgggattacaggtgtgagccactgcataaggccgttattgttattagtgcttaaaaatatttagtaaacattttatttagcctaaaaaccattcagagagcagaggctggatggaacacggcgtgccaggcggtgagagcacagaccctcctcttccagagcaggaagtgggtaaatgacttttaagcctcatttctggggtggcaaaactcttctgtatgaagaagtacaaatatgtaatgtcccataatggcagctatgggacgttacgtatttgccaaaacccacataacgcacaacgccaagagtgaactgtaatgtaaactgtggacttaagtcaatgatcgtgtcccgatacgggctggttggttgtgatgcagggcaggtgaggcccaaagtggagcttagcctgccagcgttcttggctttgcccaagaaagaattcaaggacaagccggaggtagaagagaacaacttgattgaagaggcagtgtggcagacctcactgaagatccccctaccccaggctcaagtcagagagagaggaggtggcagtgccggaatttcagctgcgcatccgtcccagctctgcactgcgggcgtccgtcccagctctgcactgcgtgcgtcccgccctggctggagcttgcagacggcagccctgcaggaacccaccggggctgactccttcctccccagatcccacaaaacagcagtggatctccactcggcacgcattcccctctacattcacacgaagtgtcttttaatggaaagtgtataaactcgttaattttggttactgcactgaagttaggcaagcttctgcagctttattaaatgaccaatgctgtccct

SEQ ID NO: 1410 - DNA, 1266 bp, Homo sapiens
agtttcggccgagggtgggctccgcggtcgccggtttctcttcccagctctgccctcgcttgctggccggtctccggggtcagcgcggggccaccatccagccccttggggcccgccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgagtgtccagtggcgggagaccagttcctggtgcctgcccatgaggcccgcggaacccagagtgaagaccagcgcccagcaggcgcagcttcggagtcggagctccaggaggaaggacccaagctgggggaggagcggcccaagccgcatgccggggcgctagaggagagaggccccaggcccgtggtctccattgtgaggccccgtcatggtccaaagagaaagcctgtcaagtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagcgaaaggcccagcgcctgcggccgctgtaccagtacgtcaactattgcaaccctgagctgaaccaggcagggaagggggacggggaggctgaggtggaggcagaggcagagctggccccggttcccgaggagggaggtgtggagcaactgcaggccttgctgcccttggcaggtgagctgggcccaggcctcgctttgccctgtcccagtccactagtgacccccacccatgccctggctcccctcggagaggaggctggagaggagcctgggggcttgcccagcttgggggtgagtgaccacaaggccgaggtggataagtcaacccaggtggacatcgacaagatgctgagtgtctgcactgctccacttgtccccccgctctctcctcagtacaagtgactgtcccgccccactggtggctcccctccttccacgcctgaatttggcttcaggcttcctgtgggcctaggccctctggtggcgggggcaaatttggcacctgcccccacttgggactttggtcttgctgaaaataaatatttttctttttcaaaga

SEQ ID NO: 1411 - DNA, 1504 bp, Homo sapiens
agaggcttgtttgaggcccgcggggactgggcgggcggaggccgggctgccgaagtgtgaggggaggagcccgagccgtcgctgctgccgccgctaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaactaagtagattaaatagtgtgataaaa

SEQ ID NO: 1412 - DNA, 1200 bp, Homo sapiens
aagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaac

SEQ ID NO: 1413 - DNA, 929 bp, Homo sapiens
agagcagggccctgctgcacccaagtcctggttgctcctccccaccacactggccctccatggaagccttgatgcagtgagccaggcccaaggacgccccggccaccctgacgcaccccccaacatctacgaggggggcctggggtccccgcagccgcagtgccccagtgcccagggaagcaagcccaagaacttccggctgcgccacctccggggcctgggcctctacctggagagccacccgccacccactggccagtgtgagagccactggctgggccggcttatggctgggggctgcctgccacagcctgagggcacagcctgggccctggacctgccacaggggactctgggcccacgtaacagcctctgttcagcccttctggaagcccgattgcccagggacagcctgggaagcagtgcttccagttccagcatggacccagacaagggtgccctcccccagcctagtccttctaggctcaggcccaagaggtcctgggggacctgggaagaggccatgtgtcccttgtgcaagagaacccgctctggggccctggagaggccatagggatcccgagtgccaggactgggtacaggaggggcaggatggccgaggaggcagcctgagcaggaggggctcggcccccggcagtggccctgccacatggggtggcccaggcagcggcccagcgcccaggcctgggcctcgggagaatgtgatggggagagggaggaggaggaggttccgagggaggggcagaagcaatagaagcatggccgtgcccttgcagcctgcttagactccagtcagccacttgtacctgggaggccgggctgagtgcagaatcaggcccccccgccaccgcctccctgagaggccggggagcccacagctctgatctcaataaaagccaaggcctgca

SEQ ID NO: 1414 - DNA, 1967 bp, Homo sapiens
aagttctgagggttaaggcaagagcccacgaaccgtggaagagatgcctccaagacgaatgggctcgataagagtcgtggtggtcttctcctcacgactcagcttcttttccgggggccctgagcccccgtcgccggcggcgcgtttgttgcctggcccagacatggccgcggcggctggagcgatgcagggtcccctgaggggcgtcaaacgggaggaggcggtacttccgtcacctgcagaagacacagagcagagatgtgggaacggctggtgttccacagccccaaacaccctccaccctgcacacacctgctggatcccgtcccccccggcgccagagccctcaccagcaggagggtcagcctagcgccgccatcttggatttcaccggacgtcactgggcgtcactggacgccactgccccccccccaacggtgcgcagggcgcaggcgccaaaggcagccccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgcaacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacggagaaagaagaaagcaaggagatggaggagcaggcagttaccccgcagaaagaggaactagagacagtggccccaccagagccagagccaagccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaaca

SEQ ID NO: 1415 - DNA, 1046 bp, Homo sapiens
gacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattggtgagagggggcagctaccaggtttgagccccagggagaagaggaaccgggcctggcacaagtgaccatgggaagcagaagcaggggatttctgcctggaatatgtcattattagtagcatcatcatacacaagccatcagctttccaatccactgcttccttatctagaaattaaggatacagcacacattttacaggactgttctgagaaataatatatgcaaatatatgcatagtgcacaataa

SEQ ID NO: 1416 - DNA, 1031 bp, Homo sapiens
ctctgagcggttgaggttggggctggggttgagctcgggttgggttcctcctggggcaggagggaaaggcgggagccagggcgtcagggcctgcggacgatgtgtgtgtgaaagggcgcgtcagccataagaagccatatgcgtgcgagccggtccccaccgtccccgcggcgttgtcaccatcatcatgaggccactggagcagcctcaggcgctgctgccggggggccgggcgcggggtgcgtcgggctctgcaggttggcactcacacccagcgcgcaggatggcaggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagagtcaaaagacggttcaatttcctatcccccaaaccgccaagatgtgcccctgcctatgccaccgctttgggggccgcctcccgatgcctagggaccaggcagtgatgccctactgggtgccccaggtcctgaggtctcagcagcagatagtcaggaggcagcagagtttgaaaggcatccaagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagca

SEQ ID NO: 1417 - DNA, 3426 bp, Homo sapiens
atgagcttctcactcacgttcaccgagctggccaacatcgccatcccacagtgcggggtgctgaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaagtcaatgcagaccctgcaggacttgctcactgatcttcatgcactccaggtcaccatcacagccctcagaaaagaagtggacatgctgaagaacatgcttgacaaggtacacccagaaagaatggacatctttgctgaagacttcaaaatacagaactggaagatggttgcactgcagcgggaagtggcttctctccagaataagtttaaaaccatccccaaaaccgaggacatggtgctctggagtggccttcatgatgccatgttcacctcagaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgcccagcctccaccactgggagactggcctgcactcccaagacgctggcctcttccccaaggctggcccagggtgggctcttggcctctgtgggacttaggtgtcctgcggccaactcagccccaaccctccagggccccaccaccagccactgagtttggctcattgtggcctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctagccaatatgggaggtccttccagcctcgggacaacagtggacatattgcagaaaaagattggcagcctccagaaatctaggctcaaggaggaagaacttgagagaatttggggcaaccaaatagagatgatgaaggatcgctacatcactttggacaaggcggtggagaacctgcagattcgcatggatgagttcaagactctccaggctcaaatcaaaagactggaaatgaacaaggtgaataagagcacgatggaggaggagctgagagagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaagttagtccacagtgatctggatcccttgaagaaagaaatggaagaggtctggaaaatcgtccggaagctgctgattgagggcttaagactggatcctgacagtgctgctggctttaggaggaagctgttcaagcgcgtgaagtgcatctcctgtgaccggcctgtggagatgatgactggcccacagctgatcaccatccgcaaagcccacctgctgtcccggctgcggccagccagcgccaacagctgcgagtacttgcagcggcaacagatgagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgccgaggtggacatcctgggcgtggatgggatcctgtacaaaggccgcgtgaacagccagcgtggggctcagcccttggccgtcgcaaaggagctggcagctgtgaaggctccatctcccccgtcacaaagcctgtatgaccgtgtgcactccagtgccctatttggcgccatctgcccccccctgtgcccccgctccagtgcctgctcagctgcctcgggccctcacctgacgatgccagctcgaccaccttccctgccacctctgctgctgctgccaccgctgattccatccctaagggacccccagcaggccccagggtccaccaggctctcaagagctccacacattgagtcccgagtcggcaggaagccccccgaggagcccgccaacccgtga

SEQ ID NO: 1418 - DNA, 1623 bp, Homo sapiens
cggctccgcccatccccgaccagccctgggatggctccacccgcgctggctccaaaatagcgagggggcggggcccgggccgtgggagcgcctgaggggcaggagtccagtgttttagccttcgaaggaccatggtgcttccacgtcatcgtgttgtggcgctcccggctatggcagtaccgtagttttcctctcttctgcctgcggtgaccattgggctgtagggtgccccgaggcctccctggccccctcacgccggcagaatggcctcagcccgaggggccaagcagtcttcgccccgggtggggaccacccgctacacagagacgtccacggtccgcgtggagacctcgtcccaccgcgtggagacgtcgtcccggcgggtggagacctcccagcgccgcagcgaggggccctccctctccccctcggggaagcggctccctcgcatcctcgaggcgtcctcccggcacgtggaatcctcctcgcagcgcacggaaacgacctcccgccacgtcagagcctcgtccctgagggtggagacgtctctgcactgcgcggagagcccgaccccgcggccaagccggccgcccgccagaacgaaaaaacggcccgatgagatgctgcttcccaaaggccaccaaggggccagggccctcagccaggacagaaaggcctccagttgccagccagccagccagctgccaggtggaccaatcattttcggtttcatggaaacaaaccataaatcaatgtaagaaacagccaagccgcagtttctgaacacagccaacgtttactgaccgtcctgcgtcttggaccagcctacttttgacccagtgaactattttcacttgaagccagcacagaaggttttcaggcccaggatgctgtctaaatcgggttgatggacaaagagaggctgtttgagcctctgagccaggtgagtttgggatccacagccctcagaaaaccttcaccccttaggaacagagaccaaactgaaataatgacctgtggaatgattccatgcctgctaaaaactcgagggacaaggaacagactcataaattattaattggcctttgtttatgtttcaaagtaaatggtcgttttctttatgctaagtctttgtacctggcacccccatccatacacttttttaaggtaggttagatgtggttaaaaatgacagtaaacccaccagcaagcaaaaataatcttagaaagtgagaggaggtcactgaaacctggcctgaggtttgaagaagatggagaagagttatatttattgagaaccggctctgtgccaggcactagatgttcctccacttacgatggggttacctcccgttgaaactattgtaagttgaaaatatggtaatttgaaaatgcacttaatacccctaacctactaaacatcatggcttagcctagcctaccttaaacatgctcagaacacctaaagttgagcaaaatcatctaacagaaagcctgttttataataaaatgttgaatatctcatgtaatttattgcatactgtactaaaagtgaaaaagaatggttgtaagagtacttaaagtactatttctactgaatgtcacttttgtaccattgtaaag

SEQ ID NO: 1419 - DNA, 3997 bp, Homo sapiens
attccgcattcctagcctggcggcgcgcgcggctccttaatgagactcgggccaagggccgacctcgcgattccgctcgcccctattttatgtttgatttttccttcccaacgccggctagcgctgggacccgaatggggccggccagctgcggcgggaggagcctccacctccctcagctgcgtttctccagggtagacgccaccgcagtcactgatgtcccttttcaaaggatgcacgctccccaccgggcgccggaggtgttttgcagccgctcttccagaggcgcgggtagggggcaccctacccccacccccagagttcgctgggcactggctgggaatcagcctcgctgctgtgcccagctcctctcgggccgcgggggctctggggctcagcttcgtgcgggatgggtccggggcgcagctgtgggaaacctatttattctgttgctggggaaggaagacggagaagaggaggggacagtgctttcctacagtagtatggtgcatatctccaacatcacaggcattgtaggtacaacagtgagcaggacaaaaccagctcttgtcctcatggaactaactttctagaggggaaggcagacactaagcttctaattgcttgcaattgtggtgtgatttggcatcatgcacttcgctcatcttatggagaagactgaggcctgtggttggaaagggcgagggagcagcctgctatctttagagaacacagtttcagcctcaagttcttcctgtacctccgatatggatctacccttcctggattgaagccttgtgccaagtccatgggcctgatgatcctctgactctccaaatgccagattttcctcctccttgcctcagggaagtgaagggcagccgatagcccacctggagaataaaatatgactacaacctgcagtgctccatggacctgtcattctcagcagtgtaaatcctactgctcagagagaaggcagttggcacaaggtagacagccagttgtttcagctattccaatcctgcatgtcatttacctggaaaggggttctatacattccctctgcctttcctactaccccagcagactgccctcggtctcacctgttagtcctagttacggattcccaaacagcaatgccactggagcttagataaggggaagtcagaggagccaccccaactggagcccgggctggagagaggacctggcatgtgtgtactcttctatcccagatgagcaccttatcaacttaaggtggtagtgtctctgctgtttccattctgtttgtgtcttctggacagaggattggcaatggttggaggttatctcagtcaccagttcccaggtgatgcctggaagaaccctgtcctcctgccaagaagccaggcagcaagtggggttctgtcccaggccccggtgccctacatggatgcttatcaaggacccatacataaactggcacccacttcctcccatgcctgacctgccctcatgataggccaggtgacatctgtccttcagcatgcctctgtttttcagaatgtctaccatcaggagacaatcagatgagccaatgtggagcatcatgaagacatgttcctgggatcatcctggaatccgactctgtctcagctcaagggggttccgagatttcctaagctagccctctcattttacagctgcaaaaacggaggcctgttaattcagtcattttatgaaatcctttgaaatttttattgagctctaattgtgtgtgaagtattatggaatgcttctgtactggaatgcataggttgaacaagacagaaaggcccagatggcagaagttcaagagctttcaccaacccatatagagaacctagtaatattaatgactaatgttaatgaatccatgctttttacgtgccagtcactgtgcccagcattttgcatgcattatctgagtcctcactacaacgctgttacgtaggtactgttattataaccattttccagatgagaaaactgaggctcagtgaaggcaagtttcttgcctagggtcatagagctataaagtagcagagtcacagctcaaaagcacatatatgtgattccaaagctcagatacgtaacccatttagccactttcactgtgatatgcaagggcccaggatttcatatatagcaaagctatcatttctgggtggacatgtttaggggcagtggggtaccaggcataaataggctgttcaacacggggagggcagtgtgtgaaggaggccagcacaggggctctgggaacacaggcacctctgatgagaaagtagtgttctttctgcagtactgttctgagtagctcagcctcttgttccccttccccagcacccagattcacacctacatgctgttagacattcaccccatttagtacacagttatgcatacacgtggctattgtagcaattgtcgaactttcaccctgcagctgggctgctttgccttcccctgtaggctgagctcccagcttagattccagcaccaatagctatttgtgggacaggagaatgtcagcagtgaagggcagcatgatggccagcatgtggctttcccaagcagagacctgggttccagtcctagaaggcaaggcaactgtattagtttgctcatgctgctgtgacaaaatactacagaccaaatggcttaaacgacagaagtttttttttctcaccgttctggaggctggagtccaagatcagcgtgctggcagggttggtttccccttaggactctttccttagctagaagatggacaccttcttgctatgttttcacatacggtcatttttctgtgttcatgaatcatggtttatcttcctcttcttataaggacgctagtcatattggatttgggccccatgaaaatggttcattttaacttactcacctctttaaagacgttagctccaaagattgttgtatgctgagttacttggggttggaacttcaacgtatgaattttggaggtagaagatatatttgagagtaaaaaggggttctgttaacccatttatgcctgaggttgcaattttttgaagttttgcaatcagatcttggcaatgacctggagcggtaggatataaataattcccacatgcttagcattccaataatggaacactaggcataaatgggctaaaaattactttggagcagcagtcttaaatggaccatttagggcaaactggaacatatggacaccctaacattctggccccatcactcactctacagccatcttcttttaaaccactgcacctctctgagtctcagtttcttcatctgttgaatggagataatcatatcaactcccccaagcaggcacttttaaaatactagtaaatgcatactgattacctgacagtactgagcaccactgcatgctctgtaaaggttaaccattgctattattgaaaccaaactgctcactgaggtctatgggcctatgtgatttgacccctagctgcttttccaaattcatttcttcccccttcccccttctcccttctattttattacactggcaccacaaaggccgcccagcagtcatatatcaagcacattcctgcctcagggcctttgtacctgttgttccctccacctggaatgttttcccctaaccccttgctcctttacttcattcaggtttttgcccaactgccacttcctcagagataccttccgagatatatgatgagctgatataaaataatgcaactattgttctacctccattgctttattcttttatgctactttaattggattcatagcagttggtattttattttagaattgcctgtgtatctatctgtctcttctgatagaatgtaagctccccaagggccaagattctgtatgaaccattcaccaacgtatccccagtgcccagaatggtgcctggcatatgtgcttaacaaaataaactgactggattatttatccatattcactt

SEQ ID NO: 1420 - DNA, 4784 bp, Homo sapiens
agatggcgcactcggctgccgccgtgccgctgggcgcgctggagcagtgccccatccgcgtggagcacgaccgccggcgccgccagttcactgtccggctcaacggatgtcatgaccgggccgtcctgctctatgagtacgtgggcaagcggatcgtggacctgcagcacaccgaggtcccagatgcctaccgtgggcgtggcatcgccaagcaccttgccaaggccgccctggacttcgtggtggaggaggacctgaaggcccatctcacctgctggtacatccagaagtacgtcaaggagaaccccctgccgcagtacctggagcgcctgcagccgtaaccctggcctgcaggcgggagcgctccctgccggactcttccacgtggcctttgcctggccccacgtgctctcaggaacctggtcccactgggaacagactcagagttatttttgtaaggacactcatctgtgccccacgtccagatccctggaggcagctgaccaatgatgggcggtgacccggtaaccgaggcggcaaggaggccaggtagtcccggcacctctcactctgcagagaccagcggcttcgtgggaggcctgtgggtcacacgtaggggctagagccagcctgcatcctgcccaccgggctccacttggagatcagcaggagggccagtgtgggacccctgctgccacctctcctgggcctgtgtcctttctggaaattaagaaggtgtgctccagagccaagaggagcaataagaaacctcgtgtgccagcttctgagggtggcagtgccagaccccacctgccagcggtgctgcccctttctcagacccccatgcccagtgcaggcagggccctggaaagggtcagctctccctgacagagaccagcagagtgaaggactgagcactggccaggctcaaccgtacgtgcggttcacacatgtgaacacacaggatgcagtctacaggcgggctggtggtgggtgccgggggtgttttcctctccttggtacccccatcttttttttggcctctcgtgtaggttctgcaggaaaccaaggccccatccccatgggctgctatcccctatacccctgtctgccaggaggagatccaagggggcctgagcagctgcaggcccgccccttgctggccttggccacctgcctgagccttctccgaggagatgccttggggctggggtgggagtgaagctgactattctccaaaaaccaccctcagcatccaagaggaagaaacatcagccacaggggtttctgtgctgctgccagacatcagtgtcctcttttgtggctggctacagccggatacactttgctgcccatctggccctgggctcctccccaacccagccttcctgggtgcagcctgggagacacactagcatgctttggtgggaccagcctttccagggcatgctggcttcccctggggctgactcaggtcccgccctcttgtgtcagtgctaacaaggatcagattcgtccctgcccttctgtagagctggagggtgacctggagccaggggccctttagggctgagacatttgttagtcggagtgatgcatccctacccggcttcggggggagtcaggctgggctctgggcagtacagggagaggttcaccaggacccccatgccttcctcccccggtgcaggggcagtggtcaccatgctgactcctccctttgactccatgcacgggcgctggctggcctgtggttgcatttcccactcacctccttgctatccccagtcttggcaccgagaccccccacattccttctccagcaacagcagcccaggggccttcctgcctggacgcaggaccacggagacctgcatgtgcagggaggcctggcagcctgccgatgggggtccccgagccccggagtctcctcgaaacccctgctgtgggtcacagcatggaccaggaggggtcaccatcctgagtacccccgacatccctgccccttgacctgtggcagatgctcctgccctggcctccaggaagtcagctcttttgcaaagggcttgtgtgagaggtcggagaaagccctgggcctccagggagatgcagctggcaggaggtgggctgagctgctccggggctaggggtggcccattgctggcagaatttaaggaaagagcaggttgtaggcacagaggatgggcagccaggcctgggccttccccttactgtcccagggcagcagagctagggtcctcttttaccctccctaaggtcacccccttcccatctacacgtccctccccaagttcaagcacatagtcaatcatgaccactcaggagctcagtgagctggggccatgtccctgtggcctccagcccatccgcaggagggtcccttgcagtgacagcacaaagagtcccccacaggaagcccctgagggccagcatggaccttgagagccaggagggaatgggcctggtgccactctgttcccactcccacctaagattcctacccctgtgttctagcaggtgactcttgatctggccagcccacaacaaatacttgaactaggcagcatggggtggtggaggcctgcagaggccccgggcccaggaactgagactagggctttctcatgaggcctcatcaagctcccgcaggtatgacctggcctcctcgcctcgggctgccttaaagcaccgctaacccacgccaaggggctaggcagggcttcgcggggcctggcccaaggtctccagcagagcaataacatcttcccaggttgggttgccacagacaccgtgccctggagcccccagcccatcccatctggtgctaccctgtctgcctggcagcctagcctcacccctcctgtccggtcacctgggggtccttggtaaggatgccgccacatggggccggtttatgcacctgggcgagaacctgactggggcaggggatgctcaggggcctgcaggtctcccacagagctgcttttctgcccgcctcaccctgtgggtttgtatttcttgccgggtcaaaataggcagtgactcgtgccttccctcctcagggccggcggcagggtgtggacccagctggccgctggaccgtccccttcctcattctccaagctcatcaacaggtctcagaggaacatttccataaaaggtgtggcctggcatgcagtgctgtctgcacgctgtcgcttcccccacagcaacctgccggtcagccttaactggtgtggaggtcgaggtggggagggggaggcgggcttccctccctggtgtctggcctctttttgctcagccctcagcacagccttcagcgtggagagcgagaccctgcgtgtcactggggcttggctgaggtctccctgcaggataacagtgacttcaggaacccagaccccagtctgggcggctctaccttcccggctggcccagcccccacaccacagttccctgccacctccaggcacaaaagcctctgaggccacagcccagctatgaagctgagtggctttgtgcggtctcctagggaaggggcagtgatgccatgcatgagatccgctgtgccataagaagttgcttcctttagaatttctggtccaatgcagggaggtgaggcccagcctcatgataacacatgcccatcaaggaaaagctgtggctaatgcttccaaaacaagtgaaaatcttgcaccaggcccagggccatatctcattccgccccagctactgagggaggggacagactgctggaggacaatttctcctagttaccactaggggttacatggctactcagaatgaaagataaattgccaggcctgttgcaatcttttttttgagatgggagtcttgctctgtcgcccaggctggagtgcagaggtgcgatctcagctcactgcaacctccacctcccgggtcaagcaattctcctgcctcagcttcccgagtagctggaattacaggtgcccaccaccatgcctggctaatttttgtatttttagtagagacggggtttcaccatgttggccaggctggtcttgaacacctgacctcaaatgatccgcccacctcggcctcccaaagtgttgggattacaggcgtgagccacctcaccaggccccgttgcaatcttactccacttcgttttcacagcagtcccgggacatgcccattattaggcctatttgatagatgatactgaggctgagtcgggggtcacaagccaaagccacaccgctagaagggctcaggacccagcccagctcccgtcctcttggtggcatcaagcttgtgtgatatgaggtcttatgtctgctcatgacagccttaaaagcaataaacagatacaacttccagcaacttcccactcagctgcaaggctgcgggggggtcctgcctcgagccataaggtgagcagctagccagtgccgggccagtgtggagaaggctgaattgcctgtgaagctggggttgcaggcaggaatattcatggagcccctgaccatgtactcacactgctcttcctcagttcagggttcttggatttgctcaagtccacccaaatatccctttacgattctcagggtcccactccttccagatccaatgccctaaactttacataagagttccggcaaggctgtgacttcaacttgtgttgtaactgcaacctgcagaatcaaatttagggttatgttttcagttgtatcagtcttacggctacaagatattaaagagattcttttctggttatcaaa

SEQ ID NO: 1421 - DNA, 2698 bp, Homo sapiens
cgcgagccccaggcaggccaggtaacggcctctgcccccgcccctccctccccgctcggacttcccttacccgcacactggctccaggcagcgcccgggcggcggaggcggctgcggagacggcggggtgcgggctgagggagccgggcctggacgccccccccatcacccccgtaccccaggagctgtgcctagtccaggagaggctggggggcgccccatggaggtgagacgcggagacacctgcccgcgccctcacccctcaggcctgagggaggaaggacttgagcccaaagtcgcgttccccggaggtgcgaatcgctgttggaacctcggcgccgacgccggcagcaggttaaccgacgtcttcggcagcgtgatgttgactggctccgcttccttctacgattgctacacatcgcagagtgaagacaatgtagacctaaggcagacctatactccattttcttcaacagaatattcaagttctgtagattcttcacttttctgtgcaccatggtctacttatggagatgacattaaacaaccttctaattctcagatcagtataaagaacaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacaatgaaaatgtagattattgtagatacccagagtatgttcatcctaataaggctaagcttaataaatgttcaaattttagtgtccaagatagcaaaaaattagccaatggcacacctgaaacaccaactgtagaagcagacacctacacaaagttatttcaggttaagccagcgaatcagaaaaaaatggaggagacaatccctgatcagcagaatttcacatttccaaaaactacgccacatctgacagagaaacagtttgcaaaggaagcagtattcactgctgattttggcttaacatcagaatatggactaaaacctcacacagcttgtcccgctaatgattttgctaacgtcacagaaaagcaacagtttgctaaacctgatcccccacattctgagtattttaaatcagtgaatttattatcaaactcagcaacatcttcaggaggtatcaatttaaacagaccaacttggatgaatgttcaaacaaaaaataacactcctattccttatcgaaatcaaggtaacttgatgaaattaaatagtcatttaagtgcagcttcaaaaggttctaaccattcttcagatttcccccaactatcatccacaaacttaaccccaaatagcaatttatttcagaaatattgccaagaaaacccttcagcattttctagttttgattttagttacagtggtgcagaaagaatccaatctgtcaatcacatagaaggactaacaaagcctggagaagaaaatctcttcaaattggttacggataaaaaaataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaagactgaattagcccttgccaagaattatcctggaaaaaaagtatccagtactaacaacactccagttccaaggctgacttccaacccatctagagttgatcgcttaattgtggatgaacttcgagaactagccagagtaagctgtaaaaatagataa

SEQ ID NO: 1422 - DNA, 4328 bp, Homo sapiens
tggctccaggcagcgcccgggcggcggaggcggctgcggagacggcggggtgcgggctgagggagccgggcctggacgccccccccatcacccccgtaccccaggagctgtgcctagtccaggagaggctggggggcgccccatggaggtgagacgcggagacacctgcccgcgccctcacccctcaggcctgagggaggaaggacttgagcccaaagtcgcgttccccggaggtgcgaatcgctgttggaacctcggcgccgacgccggcagcaggttaaccgacgtcttcggcagcgtgatgttgactggctccgcttccttctacgattgctacacatcgcagagtgaagacaatgtagacctaaggcagacctatactccattttcttcaacagaatattcaagttctgtagattcttcacttttctgtgcaccatggtctacttatggagatgacattaaacaaccttctaattctcagatcagtataaagaacaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacaatgaaaatgtagattattgtagatacccagagtatgttcatcctaataaggctaagcttaataaatgttcaaattttagtgtccaagatagcaaaaaattagccaatggcacacctgaaacaccaactgtagaagcagacacctacacaaagttatttcaggttaagccagcgaatcagaaaaaaatggaggagacaatccctgatcagcagaatttcacatttccaaaaactacgccacatctgacagagaaacagtttgcaaaggaagcagtattcactgctgattttggcttaacatcagaatatggactaaaacctcacacagcttgtcccgctaatgattttgctaacgtcacagaaaagcaacagtttgctaaacctgatcccccacattctgagtattttaaatcagtgaatttattatcaaactcagcaacatcttcaggaggtatcaatttaaacagaccaacttggatgaatgttcaaacaaaaaataacactcctattccttatcgaaatcaaggtaacttgatgaaattaaatagtcatttaagtgcagcttcaaaaggttctaaccattcttcagatttcccccaactatcatccacaaacttaaccccaaatagcaatttatttcagaaatattgccaagaaaacccttcagcattttctagttttgattttagttacagtggtgcagaaagaatccaatctgtcaatcacatagaaggactaacaaagcctggagaagaaaatctcttcaaattggttacggataaaaaaataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaagactgaattagcccttgccaagaattatcctggaaaaaaagtatccagtactaacaacactccagttccaaggctgacttccaacccatctagagttgatcgcttaattgtggatgaacttcgagaactagccagagttgtgactttactaggcaaaatggaacgtcttcggagttctcttcttcatgccagtatctctactgctcttgatagacacttggagtctattcacattgtacagtcacgtagaaaggatgaaattgttaatgcttccaatcggcaaaggcaaggagttcctagatgccaagatgacagagatgtttttgcccttgcttctgcaattaaagagatgtgtgtggctactcggaaaacacgcactgccctgtggtgtgcactgcagatgaccttgccaaaaacagccagtacagctgatgtggtaaagcctttacaagatacagtaaactgtgaagataaagtccatgaaagcataaatagtagcaatccaatgaaccagagaggtgaaacaaacaaacattaaggaaatgccagcagaaagaagaataaaaagctgataaatataccaagacatgctaaaaatgttttaatgaacttgtcaaactttcagtatgttttctttcagatttaaagttaataccagtaccttaatgaagtctaacttctatttaaaaatcttctatttgaagtgaatccgatatagttttaagtaaacgcaaaggtacagttgactactcagagttctgagtagtcagataacaagtttaagtaaattaaatatttcctaacagctaaaatgtgcttaaactcattctgccatgcaggtaaatgcaaatgtgaaattcttctaggagataaatttcatttaggtttgtcttagttaagtataattccaaataatgaatctaagtgactgtaacccaattacggctacagcctagtaaccaagacaagttttgattgtgatatcaaagtgttttccttacaaaactggataatacctgggaaacaaaggaaaatacggataaacccaatattcatgtacaaacttaatatttaaaatactatactaccatatttataaatttggaatcttaatgcctaggtatatggagggaaatgcatctgattctcctaaattaatgataaaagtgtcagtgtaaaaaccatgcaagttactgaatataaaacctattcagatcatttgtgtatattctttaaattttaattatattatcaattgttaaatgtttccaattttaaagttatttaaattgaatcacaaaacattccctttatctggatcttttagacttgatgcacagtaactgaaataatgactactgttttaatacccttagtttgctgccttttatgagggtgtcacgaagttctaaaatgtatttttttaaaggttaatctctaactagtttagcttgcaattggttagtgtatattttgtgtagttgtgttcattagtttgcttctaagttctaaaatgtattttttaaaggttaatctctaactagtttagcttgcaattggttagcctatattttgcgtagttgtgttcattagtttgcttctgtatttttttaaaactattgaaagcttaactttttctgtttctcatcacttagtatctttgtatagaacttgagtaatttattcgttaatatgaaatgttggtattatgtgactcagaagatcttgggttttaacatttctagcatgagttaaactataatgtactgatgaaatttaattgaaatatccttgactagaaacactgatgttttaaatgttagtgtttttcttagttttagaaattctggtattaaaaaaaaaaa

SEQ ID NO: 1423 - DNA, 4067 bp, Homo sapiens
gtgttgtggagaaataagaggtaagcatgcactgtaagttagatataggatttgaaatgaaggagaaatatttatgtggaaaagacatttccacataaaaatatttatgtagaaaagaaaatattcttgagttctagtctcttctttatttgaaatgatggtgtagattcagtccacatattttatagataaagatggtaaggtaggataagtctggaaagagtaatcaatatattgtatttcagcacgaattcatttatttttaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacaatgaaaatgtagattattgtagatacccagagtatgttcatcctaataaggctaagcttaataaatgttcaaattttagtgtccaagatagcaaaaaattagccaatggcacacctgaaacaccaactgtagaagcagacacctacacaaagttatttcaggttaagccagcgaatcagaaaaaaatggaggagacaatccctgatcagcagaatttcacatttccaaaaactacgccacatctgacagagaaacagtttgcaaaggaagcagtattcactgctgattttggcttaacatcagaatatggactaaaacctcacacagcttgtcccgctaatgattttgctaacgtcacagaaaagcaacagtttgctaaacctgatcccccacattctgagtattttaaatcagtgaatttattatcaaactcagcaacatcttcaggaggtatcaatttaaacagaccaacttggatgaatgttcaaacaaaaaataacactcctattccttatcgaaatcaaggtaacttgatgaaattaaatagtcatttaagtgcagcttcaaaaggttctaaccattcttcagatttcccccaactatcatccacaaacttaaccccaaatagcaatttatttcagaaatattgccaagaaaacccttcagcattttctagttttgattttagttacagtggtgcagaaagaatccaatctgtcaatcacatagaaggactaacaaagcctggagaagaaaatctcttcaaattggttacggataaaaaaataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaagactgaattagcccttgccaagaattatcctggaaaaaaagtatccagtactaacaacactccagttccaaggctgacttccaacccatctagagttgatcgcttaattgtggatgaacttcgagaactagccagagtaagctgtaaaaatagataacagtggatggattttttgttaaattttttttaagtttcaggccaggcgtggtggctcactcctgtaatcccaccactttgggaggccgaggcgggcagatcacctgaagtcaggagttcgagaccagcctggccattatggtgaaaccccgtctctactaaaaatacaaaaattagctgggggtggtggcatgcgcctgtagtcccagctacttgggaggctgaggcaggagaatcatttaaacccaggaggcagaggttgcagtgagtgaagatcacgccactgcactccagcctgagtgacagagcgagactctatctcaataaataaataaataaaactctcatcaagttttagagctttgaagggtttttaaatcacatttacatctaactctctgaaatatatttttttcatgtttggtcctagaactataatatttaggaaaggggctgggtgcagtggctcacacctgtaataccagcactttgggaagtggaggtgggagaatcacttgagcccaggagtttgagaccatcctgggcaacatagggagatcctgtctctactaaaaattaaaaattagctggacatggtgtcacatgcttatgctactcaggaggctgaggtgggaagatagcttgagcctgggatgtcagggctacagtgagccataaccacaccattgcattccaacctggggaacagagcaagatcttgtctcaaaaaaaaaaaaaaaagaaaaaaaaagaaaaaggaacgggaaaatagtcccactcaatcattttaaaagtaattttcgtaatttaaatggttcctcttgaagctcaaattggcagtggagctaatcctcaactgaaagaattttttaaaaagcaaaaatcattttgagtattatttatggagaaagtctcatttctttgtcacatttgttttccagcttgatgagcaagctgtgcttacataagatggtaacttaatagggaattactatctttccttttttttttttttttttttgaggcgggtctcactttgtcacccaggctagagtgcagtggcatgatctatgctcactgtagccttgaccttctgggttcaagagatcctcctgcctaagcccccaaatagctgggactacagatgcacgctaccacacatatctaatttttgtattttttatagagacagggtttcgccatgttgcacaggttggtctcaaactcctgagctcaagcaatccacctgcctcagcctaccaaagtgctgggtgtgagccaccaccagtcaacaaaatacttttgttttggcgaagtaggatatgacttcaagtcaaatgttgtaaagaatcctcgttaagtcattttgtaatttaatgattattcctattctttataatttcagaattttctaagcaacttagggtaggtaaacttttccttttttgaccttcctctcttaaaaacttagttttccaaataaaatttgataaagattcttcctgggaaaaaaaaatgcagcaaaacggattacctcttttattgaataaaaccattttaggaattagaaaaatcaacatgggtcaaatttgtaaatctgtacaatggaatttatccatggtacattcagagcctaacatatgaggtacagccagatgttaataaaaacttcaatcttttatt

SEQ ID NO: 1424 - DNA, 558 bp, Homo sapiens
aaaatgaaaaccatgtgttgtggagaaataagaggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacaatgaaaatgtagattattgtagatacccag

SEQ ID NO: 1425 - DNA, 553 bp, Homo sapiens
aaccatgtgttgtggagaaataagaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatat

SEQ ID NO: 1426 - DNA, 827 bp, Homo sapiens
atttctgaagtgagactaggaagagaagatgaacaattccctggattatctggcctaccctgttatcgtctctaatcacaggcaaagcacaaccttcagaaagaaactggactttggccactacgtatctcacaagaatagaatacaaatagcgaagcctactgttgataccaaacctccagtggcgcacacaaatcacattttaaaattgagcaaactacagggtgaacaaaagaaaatcaacaaaatcgagtatgaaaacaagcaactgtgtcagaaaatcgcaaatgcccatcgcggccctgccaaggtggattgctggaatgaatatttttccaagagcttaaacagagaaacaaggaaccgcgagctagtgagaatcaccatggaaaaccagggcattctgaagaggcttgttgatcgcaaaccccactatgaccgcagggcatctgagatagactggcagaattcaaggcgctatatcagaaataccacgagatatcttctctcccaaaatgaataggttactcaccatggaaaagatacaagagaaggccctaggatttcttggctgctcaggatctcaagacactcccgactggctgaatgctccatcttcagatgcttcaataaagcttggaacataaaatgcgtaagttacatttaggggacccaaaggctttatgttctcattccaaaatggggcaggcagaaggaaagatgcaatgagcatttttatttggggctatgaaaagaagttttaacgagagagagagagagaaatctgagagaactctttaaaacatacaccatcatcaccatcccgt

SEQ ID NO: 1427 - DNA, 3199 bp, Homo sapiens
aattcatgacaatgagcgtggcgaccaccatgacgaaaataaggaacctgaggagcccggaaggcatgacatcaccgttcctcctcccagctaccgaaggcgccgcgcgctgacctcacaaacacggcttctcctggtacgggctggttacgccctccagctgcgccccctacacgacgacagacgcgtcccccagcccttctcctgtcctaccacttgtggcggccatgaaggggacccccagctccctggacaccctgatgtggatctaccacttccacagctccaccgaggtggccctccagcccccgcttctgtcttccctggaactctccgtggccgcagcccatgaatatctggagcagaggttcagagagctgaagtccctggagccacccgaaccgaagatgcaggggatgctgcctgccccgaagcccaccctggggctggtgttgagagaagccacagccagcctcgtgagcttcggcaccaccttgttagagatctcagccctgtggctgcagcaggaggcgcggcgactagacggcagcgcgggcccagccccagacggcagggatccgggtgcagcgctgagccgggtagcccaagccgcagggcagggggttcggcaagctggggctgcggtgggcgccagcgcccggctcctagtccagggagcatggctatgcctgtgtggacggggtctgcaggggtctgcctcattcctgcgacagtcgcaacagcagctaggcctcggaatccccggagaaccggtgagctcaggacacggggtgagttaggggccagaggcggcggggctagggaggcactgagccggactgtcccccaagagagctactcgggagacctccaggtgacgtccagcagcagtgaggaggacggcggaccagggactccatccccgtaccagccccacccagcgtccgaataaagcccagggcggggcgagacagccagagcttttcccggggtctctgggttttggccacgcccccacccttcacactggccacacccccgcgggggctccggcttcacctgcccaggagcggcacgctcagagaagtctctgggattttctgggcaatgaggaacaagaagacggtctgggcgagcaggacgttgatggagaccgtgcatttctggccgccggctggagggagagccagtgagagcgggccccgcctcccgggagcgagcccgggtttgggggtaggttcggggccactgcttaccctgcgccggcaggaagtaggcgagcagcaccaggcccgagatgagcacacagggcacgatgatgttaatgacgtagaagagcggcttccggcggatgatgagcgagtagatgacgtcagtctcccctgggccgtcggtggcgccaccgtggtggcggcggatcacccccgggcagaagtcgatggcccactcgccgttctctgcgggacgggggcacggtcagctggctgtcagagcggggcgcccgccgagctgacagcgggctgaagaggaggctgcggctgtctgcaccagggtcatgggccgtcaggatgggggcaattacggacagaaaagggcattctcgttgagggtatggaaagccagaaggcaggactagagtaacaatcgagaatgatttcaggacaggggtaagctaaacccagttgtggaagtcatcctccagtgtcgttggtccggggcaagcccaccgtggaagtcccctctctggaccccgtctagaagcgggtttttctgagcaggcaggggcttcaccagtataggcctctgtgtcgatgtcgatcttgttgatggtcttgccgtcgttgtctacggcaaaagtgaactccacctcttcggcattgtacgtctgagagctgcggagccagggccgggagcccaccccagaagctctgacctgggccccggcctcaggcccagccctggaagctgggatctagcggggccgcgatcccaagcccaccccttcacccaagcccagcccgcacgcctctgttcccatctgtacctccggccgcgctggagcgtcccacccagtgcctacgcctggctccgcctccagcgcgaagccccgccccgagggcggtgcttcccggttggccccgccccataaggcccccccccaacaataatcgtccgggcctcggagtagctcttcccaccggaaaataagcgaacagttctgccaatcgaaggggaagtaggtgacctccactgcgcagacgctgcggtagatggccggaggcagccacgtcacggagccgccctcgtagacgagcacgttggcgtcgtaggccactccgaactggccatcaatactgtgggctcggggaaaccgagctttttgcacaggtctgcaccctctcagagtacccccttccccaaccaagtccagcccgcaccccaggccggcttccctccagcctggcgtctggcccggttctcacttgttttccagcacaatctctggcagccacacgagttctgaagggactcgcagggtttctatacccccaaagtcgtccttgctgtagttgagtcggtaatcctgccaatcctaaggggtgggggatggaaggccgcgtgccctgcatctcccacctggcgctgcctgggaggggtttgggggaaaaggggtgccctggacaagacctcacaccattccccagatttgactcacgattccaatccagacgctagtggtgagagtctcctctttttcattctgcagatgggagatggggatgattgaagtgagatttcagggccagaagtgagctttaggacagagctcagcggttggggccagaagtgggatttttggcttaagatgagggtgggggtagcttaccagtgagatgagattcgtcagggtgaccttgaggctgatggtgacagtatcctcaggctcccgcactggccggcttcctgggtcatagttgttgaagagatggtgataaagacgcagttcctcgttcttccccacacccctgcctgcgatggggtcaagaaggaagggtcattggcaatgaagaggctggagcacctctctcccctctgcctcccctgggtcctcacaggcctctgaggctgtgtactatcagtatctgtctcctaaaccaattatgctgtgcctgggaacgaaatactgtgtctaagtctc

SEQ ID NO: 1428 - DNA, 501 bp, Homo sapiens
agtccccggggcgcaggcgcactcgtcgccgcggcggcgtccggggctggcgttcccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagagccattggccttgttggctgaaagccagaaatcaggggagaagctgaccttgctccagaggctcctcttgccgcggccatgttgctagcatcctt

SEQ ID NO: 1429 - DNA, 189 bp, Homo sapiens
atggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtga

SEQ ID NO: 1430 - DNA, 4107 bp, Homo sapiens
gtgtgtttgtgtgttgtgtgtctgtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacggggaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggcaaaaaagaactttgccgagaaaattgtgtacctgccagaaccaggagaagtgtgttcctgtttcttcacgagcagactcgcatcacaaagcatgaatgttaacccacagaatccaaggagcatggctggcccgtggggcaggtggagggagcagtcttcgttcttcctcccctcagtggcagtttggtcttcacctgtttttaagctaccttaaacgcacttttccttcctgcacagctaacttctacatcactgaaatgcccattccttcctccgtcccacctccagccgaatagaaggtctgctcccggatcaccctcagccttggtgctcagtggtcccgaggccctagacccccaccccccgccagttgctttgtctggtagctcaagagaaggcagagccccagcacctctgtgccccccagagctctgtgcagggagttggccagctgccgcatcatcggccaccaagggcacaagaggcggaggctccagtccctgctgggctgcctcagtcttcagtgctgattgtgtcacgggtcagcgtgcgctgctgagccctgtactgttaacagtgcaaagctagtgagtagctgtcaggttccctgggcctgccatcagggatcactaaatttaaggcttccagatccctggcaggaacagattccagtcctgcttactcagtacatttgctccaaacttttcaacttgagggcaatactaaacttaaaaataagagtttttttattacaaaattatttttatggtccctttaacgaggaccctatggcaaatgcacaattattcagaattacattttatcgttttcacattgaaaacagcaaatgttgacttagtaatttttatatcgatatctatatgtatatgtatatttaatcaaccagcagttttgaaactagtcatcctggtacaaaagttttgcagcattgcctaaattatagtgctcaacacaagaactgtttttggggccagtttagcatttgtgccgcctccttttgctactcaaaacagcaatgcttggcggcagccttccatgaggcagaaggggtcgtcgttctctgaaaacagtgactctgaaatgttgggacaggggaaggggtgggaaacatgaacatgctcaaataactcgaggctcacgtgccaaagtgtgtgtgtgtgtgtgtgtgtgtgtgtgtgtgtatgatgttttgtttttttaaatgttttaaaagcttaataggttggcatcagttgtagcccacaaacatggctagggctttggggatttggcatttttctggtggtttacaagacttactccgaatacaagaggaaaagctttaaaaacaagattgcatcataacccccaggagcaaagcaacctggaggctgcatatccatgggcgggcagcataagagaatgtgaagcccttcagtgagacgagacgagcaatgggaaaccttttctgttcttaagaagtgactttaattttattgacatatgtactgtatgttactgagattgaatgttaggggaagccttaaggtagaggtatttgggaaagtagccagtgggcacttgtgatatctaaaatctgttatcccaggactgtgtacagaggggcaacctacccattcaggaaggtcagggctttggaaccctaaaaagttggcccgatgacttaaagggaaaaataattcattcccagagatgagtcagaacagtctcctcaatcctgaaattcaacaaggcatcagaagggctggctgtggtcaagcccagctgctgtcatgtgaggagatgctcactgtggtcttgttgagctgatggccttggttgagctgatggacaagtgaaggaggccatggggctgtgctgtccttcctgccgtacgtgccattccactctcttcagctctcccctcaacagcatgcgagcccataccttctgcatttttccaggcctgtgagggatataggcctccccttggagcactgagtccggaggtcatccctgagctcatccacggctcatgctgtggctccgagtagtggtttgagtgggcaggaagggccatttgcaaacactgctgtgttctagacaaacaacccaagtcctatggcaggatttcttccttccttccttttttacccaggtgatgaagtgcacccattgtactgggaagaatgaagaggtgatacctttactagatccttcagacacatctatgagaagatttgttcatttaaaagtctgcccactgaggatagggaaaggattaaggatttttccacctcctcttagtaactcctgaattaccaacatcaacttctttctctccgttcctgaaggaactttggggaatcatcttcatccgtagttacgctttcctgaaccttctcagtggtttacatgcctctgaaactatgtgcaatatttttggttgacacttgtatccatccttaagaaattagtgcagattgcagatgttctgtcttccatcccaaacaagcctgccatgaggtaggatcctaggggtttggctgttcttactccactgctcagaaagcttccattctgctgtcctcagcctcgaccctcttctgtgctggacttccacccacccacccttttcaagtttagatagtgtttcagctgctgtcccaaagtaacaaaacaatacctactgttaagtaggaagtcaatctgtgtgctggttttgttggttatgtggaaatcacaaactccagaggagcaaaggggtttttcaatgtcttttgctttcagaaacagagaatataatattctcactaaggccttgaattgatttttttctcataaaatagtctgataagctaatttttaaaaagaaatgccattaactgtgttgtatcgtggtttaaaattactaacaagttgtgggaaagaaaaataatatttgattttgaatcttaaatgtttttaaaaattagacttgaatgggcacaaagtataaatattttgtttctttatggaggacatgtggaaggagtttgagggtttgggatgggagaagtattttgcagagctatcaatgtccaaataatttaaaaaaaaaaataaaggtatttaagcagtg

SEQ ID NO: 1431 - DNA, 1199 bp, Homo sapiens
ccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacggggaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggaacattggaagatatctggatctgcagactctgctagactggactgaaacattttgggtgagagaggaactaagaaggccacccttggtactggcatgtgaggtgtggttgagccagggagctgaacctatggagtgcttcctcctccaacagtttgtggctgcttttgtagtactcagcatttcccctaactttcaccactcatggaggactcccaggttcccacgtgggactcctggagctctgtactgcacctgggtttgtctgagatttacaatgtctaatacacttcacctaggctgtcattttttcattataaactagaatcagagatattgtattgcatcctcagattttcctgagtggtatttaagttgctattatagtggtactataaagtcaggattccatatattcagtctacataggataaaaatgtctatgtgacaccaggtgtggtggctcatgcctgtaatgccagcactttgggaggccgaggcagatggatcacctgaggtcaggagttcgagaacagcctggccaacatggtgaaaccccatctctaccaaaaatataaaaattaaccaggcatggtggcacacacctgtaatcccagctattcgggaggctgaggcaggagagtcacttgaacctgggaggcggagattgcagtgagctgagatcatgccattgcactccagcctgagcaacaagagcaagactttgtctcaaaaaataataataaaataaatctatgtgacaaaa

SEQ ID NO: 1432 - DNA, 1284 bp, Homo sapiens
agcgcccaccagtccctcagccaaagagcacactggaggcggagaggcagcatccaccagcccgctccccgcctccaggacagagcctcggtctgcatgggggtgacaggtgcccatggatttccatgctgcggcaaagggtcagtggaggttgcagagatgcgagatgacttaagtcaacaccagatacaagaggaacaggagctggaggcagacatgctagagcagaagccccaactccaagtggacctggacctggacccagacccagacccagacccagaactggagatcggacaggtgccggctttactggagtcagagctatacccagccctcaagcttgaagctgagctggacacggaagccaactcgaacgaggagtctgactttgaagaacccatgcagctggtatgcaagatagagtccgtccactccaacatggggctgcccacgccacagaccttcagaccgtggagtctgaattcaaactgccggagtttcacggaggagaaccacgtgtctgcctgccatcactccatcagtgcgcagacctccaagcacctcttctgggcaaacaagctcatccaggcctcagagcacagcctgcagcgggccatcaacatgcagctcaacaatggcagcgcaggccagcccatcagatccccgctccgggaggccatccccaccaacgccctgtgctccgaggagcagctccagatccctgatgcccactcagctcctccaaccacaagctcccaggcaccaagccccctcctgtcctcagatctcccgccacccattgacctgacagagctaatcacctttgcatcttccctggccatggcctcctccagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagccaccagccacgtcccctctgctgcagggaagcaaggaagactcagtgccgccaggaaaagagaaagagaatccattattggtgaaaatccattttaagctgtcagcccccacaatcccagagaaatgactagacagaaccaataaagcctccagtgctggc

SEQ ID NO: 1433 - DNA, 1907 bp, Homo sapiens
agccaaagagcacactggaggcggagaggcagcatccaccagcccgctccccgcctccaggacagagcctcggtctgcatgggggtgacaggcatgagtaggactttgccagaagaaggctttccaggtataagaaatagcatttgcaaaggcactgggtgcagaaaggcctgcggtactctgggggtagcttcggcttagggtgagggacaggaagctggatgccaagagatgaaaaatgaaggtagagatcagaccaagaggccacatggagtctgggggtaaccggagacaagtgagatgtagcaggctcactctgaggtcattgaaaatccaggttggagggggacatagttgcagtggtcccactggaagactaaagagatttaagacagtgcagtgagtagcatcccagagtttggagccagccagacctgcctttgggtcgtgtgctgctcttaatagctgcatgacctcatacacgtttcctcatctgtgagaggagagccgtggccaactgggcataggagtcttgctctgtcacccaggctggagtgcaatggcaccatctcggctcactgcaacgtctgcctcccgggccgaagccatcctccctatcaaaacctaacaaagacattacaagaaaagaaaattatacaccgatatccctcatgaatatgcatgtgaaaattctgaaaaaaagccaatcagattcaacaacatagaaaaagggtgcccatggatttccatgctgcggcaaagggtcagtggaggttgcagagatgcgagatgacttaagtcaacaccagatacaagaggaacaggagctggaggcagacatgctagagcagaagccccaactccaagtggacctggacctggacccagacccagacccagacccagaactggagatcggacaggtgccggctttactggagtcagagctatacccagccctcaagcttgaagctgagctggacacggaagccaactcgaacgaggagtctgactttgaagaacccatgcagctggtatgcaagatagagtccgtccactccaacatggggctgcccacgccacagaccttcagaccgtggagtctgaattcaaactgccggagtttcacggaggagaaccacgtgtctgcctgccatcactccatcagtgcgcagacctccaagcacctcttctgggcaaacaagctcatccaggcctcagagcacagcctgcagcgggccatcaacatgcagctcaacaatggcagcgcaggccagcccatcagatccccgctccgggaggccatccccaccaacgccctgtgctccgaggagcagctccagatccctgatgcccactcagctcctccaaccacaagctcccaggcaccaagccccctcctgtcctcagatctcccgccacccattgacctgacagagctaatcacctttgcatcttccctggccatggcctcctccagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagccaccagccacgtcccctctgctgcagggaagcaaggaagactcagtgccgccaggaaaagagaaagagaatccattattggtgaaaatccattttaagctgtcagcccccacaatcccagagaaatgactagacagaaccaataaagcctccagtgctggc

SEQ ID NO: 1434 - DNA, 2077 bp, Homo sapiens
agaacaacagccacttttgtgggagcccaagaaacagcagctttaaaacagggtaaatattcaggcatcattaggatcctgaatacaagccagccagtaaaatacgggatctactcagaagggcacaatctatcagatggtcaagacaaataaacctggggccaaggtagcggtttcagcacagagagggtctgaggttactactaacacatcccctcagcagggacatgggtacgttcttgcctcaagccatcgaagtgctgcagtctccctgaacccttcccaccgaagatcagaagctgcacatcccaccactccccattcagcatcagactaccctcgatctgtctccctccagtcaggacctggacactatgcagtacccactcctcggggacccgagactggaccaagaacagaatcatcccgccattcctctccccatctaaagagccagaagactcagacactggcttcccatgcttcaagcagacaatggaaagttagtccacccagagaggaagcagcacgaagaggcagtgagagcaagtcagggcgcgaggtcggccatcatgcttcatcaatcccagatgccaaatctactcatcagttgagttttcaagaccagaagaataacttacaatcacaaatcttagaagatgacccaccatccaaggtccagaacccccaaggagtcagagttccccgtaggattttgtcttacccaaaggatgaagcagtacaaactgagcccatccaaagaattacgactactagtgagatcagatctccaaggagtccctctctcctagagcacggaagcagctgtgtctctgcagactatcagacagcccagagaagggtccctgtagaagaatcagaaacaggtccttacggtccaattccttcaaaacccaaggccttgtataggaatatgaacttggactcattgctcaaactctctgtccttaaagattctgatggtgtacaccgagtttctgcacgggtagaccctgagtctcttcataagtattctgcctatcctgaaaccaagccctccgcaaaggtcttagtatcatcacaggtggagtccaacgtgaggaccccaatccgaggaaacagcgaggttggccgcagggtcaccatctccccaggggtacagtcagtagagccaactcaccatgtgacagttccatcagtgtctgagggctcccacaagtcatccatgtttgttactccagagcccatctataaacagcaaacccaaaaacccccagaaattacttacatgtcccaaggacctacacccaggtatccagaactctcgcaaaagccctccatccatgcagaactggaactgacccctaggcccttgcctcctcggtccttacctaggtacggacctgactcctcatggtggcccttgctgaatcctgaagttgaaacaccccaaagccagctgacaacaccggattttgagcctaagtgctctccttccctagatcttttattgtccggttttaaaatagactctagccctttctgtgaggatctgaagttccagagagagaaggcaagcctatcaccaccatcaccaccaaaggagtttccaagttgggcaccactgagtgaagtgccacagacccccaagcacacctgcaaacaacccattcaaaggtttactgctttcttcctggatgtctctgaggaaatgtacaatcgtgtcatctggtggctaaaaggtctgtgcttttccctcctatgggcccactgtgggagcttgggggatgggaggacaggtgaggagtggcatctatgtatctacagagctgggtcgtttaggagataaatgctgggattttgacctgaagaagcagaggaacttctcatcttgctgaaaatttcaccattagagtcatttctttggggcttggaaccttttccattttcaagagtctccttttaacaggaagttacttctggaatggagaataatttaagcctcatggccttttcagcttagttggtcatctatcacatgattttaaaaaatacaccaaagcaaaccgcctgcttc

SEQ ID NO: 1435 - DNA, 1189 bp, Homo sapiens
gcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaagaaagagccttccattgttagtctaatttattttaacttgatagaaaatgagctttgtgtttgtccctcctaaacaaaaaaataaaaatcctctgtctcattgtttagta

SEQ ID NO: 1436 - DNA, 1031 bp, Homo sapiens
atcccagtctctgatcagggaaagcagggcacagccttgggaagaatggataagcatggtgtgaagacccccttgtggaagaaggaaacggaagagctccgggccgaggacgcggagcaagaggaagggaaggaggggtcggaggacgaggacgaggacaaccagaggccgctggaggacagcgcgacggagggcgaggagccgccgcgggtagcggaggagggcgaaggccgcgagcggcgctcagtgtcctactgcccgctgcgccaggagtccagcacccagcaggtggcgctgctgcggcgcgcggacagcggcttctggggctggctcggccccttagcgctgctgggcggcctaacagctcccaccgacaggaagcggagcctcccggaggagccgtgcgtgctggagatccggcgacgaccgccgcgccgcgggggctgtgcttgctgcgagctcctcttctgcaagaaatgcaggagtctgcacagccacccagcctatgtggcgcactgcgttctggatcacccggatctgggtaaggcgggggccgctgggaactcctgagcgcccccgctcccagcctttgtgccctccatcatttcctggccccagaccccctaccgaccttctctcttggagcgcggagccctcttcgacgcattccgcaggaccgccccttctcagctgctgcccagagcgcccccatccgtcaagaaggcccactgttggtgcttggttcccatctgtcacctagcgcccccagtgcagagcccagcataacctagagcccgctgtcaacagcgcccaccgagggctccccgcccccacgcagcaccagcgccaccgcacacctgactctgtccgctcacacagcctcaccttcacctcttgggtatttcagatccgctctggcccagtgggcagaggcatcgcctagagaaaataacctcagggttccctcatccctctgacaaacctgcctctttccctgaaaccattcaataaaacctctgatcaaagtgtca

SEQ ID NO: 1437 - DNA, 7912 bp, Homo sapiens
atgcgctgtgcgcccggccggcgtggctggctgtttgaggactgcgcgcggagctccgtggcgggtgtctgaagtcgtgagtttactgcttgtaaggaacatagcgatcactgggaacctggaagtagagactcctttctgccatccatccgtccctcgggctgctgcgaatccccccgccggcctccaggaccccgggctgactgaacgcccgcaccggtcccgccgccccagggcccgctacgcgcccggcataatgggagaaaaatcacgacggaaaggcccagcccctcgccatgcagacgggaagcttggccgcacgtgtgatcacccttacgccccttggagtttcaccccctcttcgcgggctccaacagcctgggtcaggcctccttgtcctgtgtgggcctctcggctgcaagaacacagtcccgagccccggcgagcccgcgcgcctcccacccgccgtgcacaggctgcactttacgccccagcactgcgcctgcgggaccatctggatcgcttttccattctgatgacgtcctgtacttcgtggctgcaggctcctcaagccccaggtctgtgcagagacgagcaaagcagcagaatatccgtgccacagctttctggagcacccattttactaccagatttggaaggaacgaagttaagtaatttccaagaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttgagcaaatgcctccgcattttatgcaccttcaacctccacagccaaaggcccccaagaccaaacatgctgtgcacacacagcagctctttgtgtcccactcctggccgatctcctgcatcatctcgttgagcttcattgaaccccgcagtctgcatgctctgtggaactcagggtcttcattttgcatgaaactcagggtcttcattttccgtggaactcaaagtcttcttgctctgtggaacttggagtctcagggcctttgtgctccatggaacttggggtctgtgtgattcatggaactcagaatccttgtgctctgtggtactcagggtgtgcgtgctctgtggaactcggggtctgcatgctccatggaaagcaccaggatgcacttgaccccccacacccatacatacatccttcattttattcctggccctcacctgtccactctgtgaggcttcttcacccccactctcctttgagctcatgccgggtctttcagactggcctgaagcatgggtgttcgtaggggggagtggctgatgtcacaccttcaggcaaattctgctagtgtcacacctgatggagctgcctagggaggatgtttccttggaggatgcgccctggcagccactggcttcttacggtgcctgcactgctgctgctgccatgggggtgccacagggccacactgggggctgttctggaattggtggttttcatttccaggttaggtagggactggcaggcaccttggctgtccttgtggcttctgtcttgaccctggtcctccccaggcagctgattttctgggctgctgctcttccaggaagaattaaaggtgggaatggctgaaacctcagctttggattcacagagaccctaggctgtgtcatgcagaaagggaaaggattgcagatggtggtgggatcagccgaaggcagggccttcactgtgatgctggagccctccatgctgggatgtttgcatacagcccaggttcagttcggtggtccatcagcgagtcctggatctggtctcactcacaagccatggacaacatgagctcagtttgccaggactcttggggttagggagagctcagcatccgggtggctctggttccttctcatgctgaaactctgctggtgttcctccatggggcaaatgtgggtttttctgaggtgcccctcttgctggagttgaggatgagaaatgttttcagtgggtttgcaccctccacacatatgtaagaggtgttgtgtttcattcctgtcaggatccattgctgcagcttcctgaagttgtgtccgttaaaaggcagggacccggtgtccaggctacagagggtgactccaggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcatgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaagaatatgttggaataattttaactgccagacctttcctcttctggtgcccgagggaaacgccctgctgcttttagctgtcttgtaacccacacgccttttcacttctgaagttgcaagaataacggctgtggtttttcacacaaaagggttgcagactgggttaggtccctgttccgccaacctggctgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggctggaggggctctgtgactcccattaatgacagtcactgccacggtttccccaggcaggatgtgccaggagaactgctccatgttggctcagcagaatgttattataggtagctcaaaaagagagggaacagggcttctctagattatttcagggaacgagctattatttgaatgttaatttaagactattttatcaattaaaaatgtaaggcccaagaaacttcagtgaggaagaatgaacaaattgaataaatactgttaaactttatgcttctttcagcaaatattttctgctcgtctctatgagtcaggcactttgctagataacataacatagaaacatagcatcaatccaatatggtgtgggtactgtatgtcaaatttaaaaataaaagtgctatataagaaacctctcagtgccctggaggcagggtccagagacatatcctgtggatgactggggctgaggtttaagggatgagcctcggtgatgagacagacgggagagggcaccctaggaaaagcgtcttcaggcaatcgtggttcagtgagctgcagccgtcgcggcaggagattgaggagcgcggcctatctggtgatttgctgtggttatgttctgtaaactcgccttgggtcctgaagtattgcttctggggaaacacagggtaaggttcctgcaagcctctggttgcaatattttcaactgccaaggcaccattcatgttccatgggttcattttccaacatccctgtaaaacaaggcagtcccatcagtgttgaaaactgctctccacatacccttttcccgtagagtacttcctgatctacagagctgccactcctgaaaagctaacactttccatgccatgctgccttttgaaaggtgccagccaggcagcattagctaaggcctctttttggctctcctcacaacagtgctgcccgctgtgctttcattggtcatcatctcatgaagtcacaaatgtagctgcttttctatggtttccatggttttgccacactctaggggatattagttttgcactttcccaagcagcctcgtgtacaggttggtgaagctccccttcctctttctggatgcactgtagtgtttgtcattagcgttgaactcacagttcgcagcactagaacccacacctgaaccaagcttggctaacaagcgttttctctgtaaggcacattacagccttcttgctcataaggacactagacagcgcttcagcattatgcttggaggccgtttcaaacagtgaaatcaacaacaagaagctcaaaactgcaaaagaagtggtactatagagaccatgagaagactggtttgcaggttgagagtaggaacaagaaggcagcgtggggccctgcatggcctccgctgggaggccgatggctcaaattgttgccctactctgcacatgttttcctgtgactgtgaaagcaacacgagtattgattcgggggttaaaaatacattttaacaagcagaaaagttcacaaatatgaaatagtggctagtgaggaccacccccatgctggagctgcagacagaggcttttgtgagtgcgaggcttgctcctatcccgggagcttctggttgccaccagcaccttgtaagccagggagtggtgtcacctgtactgtagcaaaagcaccttttctaaatgtgaagtatggcttgaagagaggaagatggaagatggctgtgttagggatgaagcaaggatgggggtggattgaccaagctgggccagaggtgcgaggagctgatctgcgagccctgtgtgcctgtgagtcctggcggagtggccgtgcgtggtgacagggaggaggcatccaggacagcacccacgttcccgcctgaggcacatgagggtggatgacagggttcggggccctagccttcaagtcagacacacctgagttcaaatccagactccaccactgactggctatgtagccttagacatgttccttcacttccctaagcgtccattttctcatgtccaatacatagattactatgccataggaatattaaatcactcagtgattttgaggttaaaatgagtgctggtgctttttattgaaataaaatgggaaaagaagcagcatttgaggtgtgagggaggggaatctgggcatggggagttggatgtgcctgtggacacccatggacaaatgtccagcagccatccaatgtgctttcgggatgctggggccaggatgtggggcagcaacatacagacctggaagttacaagcaggcaggcagctgctgcagctgtgaagagcaggcagtgcaggatcagaggcccagggtaaagcctggggaatgccagcatttagaaagaggccgctggagatcagaaaagagcaacaggaaaagcaggagggtgtggagggatgggaggtgcaggaggagagtttccaagagggaggggcaggagtcggtgttctgcaggcatggactggaagtcgtagtacttttgaactgtagggacctaagacatcttttagtctaatccccttatctatccggaagaagaaatcatgattccaaggtgacatgagttgcttgctttaggtcacagtgatttcacattgggatacctcgatttctaatgagtaatagaatatttaataaatactctcgaatttggaattgctcctattccagtcacactggatattttcccaatttggtgaaactgatattttaacaactgttaaccattccatgtactaagatgcttatagtcaaactgtgcctcttaaacctatttttattgtgtatttaacaaattttgctataatgttaaaaacaacttataactcatcaaactgcattttaattttagtaaacacaaattacactgaaacgggagtgttccctggcccctctcacaggacgtgtgacaagggttcggctcgctgcctgttcaaaccccttacgggagggggatcacgcagagggacaggtgcaggagcccaagtgggtgtgtgctacagtgtgctcttttagccttggcatctgtggatggcttgagtgttaactagctcagtggaccctcagcctttctgcaaaggcagagggtcattgtgacagctttctgtatcccaagctcttgtccatgatcctggaagaatcaggtcacacacagacttgaaggataaatgcaggggtttcactgaggggtagaagtggctctcagtaggatgcatggggagctggaagtggggagggagtgcgaagacgatcttcccctggagtttggccactggacggccaaactcctctcttaccacccgcagctgaactcctctcagcgttcaggtgttcctcatcttctcactttctctgccatgccgttctgctgtttgactgcttttctcttcatctcttcatctgctcctggagcctggggtttggggtttatatgggtacaggatacgggggtgtggtgggccaaagggcaactttttgggtacgaaaacagaaatgcctgttcccagttagggccatgggtctccaggcttgagggtggggcctttgctggggagccgccctcttctatgcagtatttccctgtctcttttctatatcaatacctcaataaaatttagttttaaaaaatagcacatgtaaaaagtttggctatttaaactaaaaagtaattatgtcctaaattattttgtatacaaagacctgaggacttgaaatattgtaataattggagcttgtctctgctttaagggcaccactcgcccctgatccatcttggtttcccgcacaaggcagcaggattgcccatgaatgaacatgggtgaaatcgttggatacaggtagtaaatacattctatttcctgaaaaatattacctaactacatgtctagatatggaattgcattttcaagccaagctggaattacaaattgtagcccatttgaaaatgcatacaaatgtgtgacatatacacccagaggaaaagaagtcacagttatgaaagaacaaagtgggaaaatatctttttcatgtaagattgagcattttggttgatactgtgataaaaaatcttgtgactgattctcttttgcattggtttttagtgtcatgtgcactctgcccaactcagataaaattgtatatgatgtaaatagcaggaaactataaatggtgatattgtcctgaaaggaagccacttcatttttcaaagatttcttccgcggcagggatctaggagtgtgcagggatggagttttgcatttctagaggaaacagcaggcagggtgtgtgcagccggaaaggaggcgtctaggttccaagggcaaatcccacccccttagaggggattggagagcctgggaaagaggctgggctgcctgtgatccccaccccacaccctgcctcctacaagcccctagaaggtccacactttgagttgtcagccagagacagtaactcaaaacctcggcttcgggcagccagaagcccagaaatgggggagagggcaggcctagacaccagggatgaaaataaagtgaatattaaaaatta

SEQ ID NO: 1438 - DNA, 2388 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagacagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgctt

SEQ ID NO: 1439 - DNA, 651 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccaactgccttaacagttcccactcagcaactccactgggaagtctgtccgcaacgctcccctgttcaagcacttcagcctctccaagctgctag

SEQ ID NO: 1440 - DNA, 2725 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagacagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagcagagtgggagaagtctggaggacatcatggtttccgcgccccaaactccaacccatggtgctctggctaaattccagacagagattgttgctagttcccaggcatctgtggaggaggattttgggcgagggccctggctgaccatgaaatccacgctaggcctggatgagagagaccctagctgcttcctctgtacctacagcattgtcatggtgctgcgcaagcaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgctt

SEQ ID NO: 1441 - DNA, 3931 bp, Homo sapiens
agagctagagcagcgccgcccgaggggcggcaggggctgaccacagagagcgcgggggcctccagccgagaggaagggagggcagctcgggccgaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtgcacttcataaagcctgtaaaatttttagtaaaattcgaagtggtaagatttatgtgaatgatcttccagtgatcctttgcatcttgagaatttctataagtgatttagaaatgcgacaggcactaaagactgttgatattgatgcattccaggatgccttgaagattttctgtaggataaaaggtggtcgagtttcaactgatgacgtgtttgctgttttggatagcatgggtatccctataaaccgtgaaattttagaagaagtgacaaaacatacctatattgacagtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgaaggtgacaaagtacaatttgaagaatttgcaaaagtagtaaggaatatgcgtgatgctgccaggttagaagagttacaggaagttgtcttagctgctgatttgctggaaggtgacatgatagctgggaagaacttggaagactttctaagaaatgttgggattaagtcacctaaagaagaggtagagaaaattcttcaatcagattttgtttctgaagataacatggtgaacattaaagactgtatgagggctttgagggacacccagaaattttccaattatattgatttcaggaaagaggcttcaaatctaaaattaccaaaggtaaacgagattaaagaagctgctaacatcttgtcacatgtcgataatggcaagattggtatacctgatttggagcatgccttgaaatgtttgaatgttaatttaactgaggaggacttcaatgaagcccttaactgttgtaacgtcagtgataatatggaggtggatttaaaagatttcttaatgaaaatgaaagaaagtccacatttccaaaagtccaaggctacacagatactcttagctactacccaaattctccagaatgatctagttgatgtctctgacctcaagacattattgatggacaaggaccttcatacagctaatgctatacttactgtaatgttaagacatgtacctgaacatgaaagtggcaaggttagcattcaagaatttatgactaaattatccgatatattgacaattcctaaagctgcaggtaagttttatttaatatgtacttattgcccagatctagaaaggcaagcagtggtttacatgttaaaaacaatacaggattcgatagttaaagcacaggtaagtaagaagcaatacaatatgaatataaaacaacacaagattagtttacataacttctgtttgaattctaaggcaaatattgctaagcttaacccaaactcaaaattttaggtagtcttacttgatagtgctagaaaattactagattatatattattcagtatgcatatttgacttctgaaattattagaaaataatttttaaaacttttgacaaatccagtagaatttttatcactatctgttatgttctcatgtatcttcagcgactctcttgatcacactttttaaacattcatgctttttgaggtataatgtacatatggcaaaattcactctttttaggtatacagttctttggattcttaaaaataatgtaatgtaacccttactatacacaacatatagactatattatcccccagaagtctcttatgcccttttggtaatccatttcttcctctaccctgagcccctggcaactactgattcattctttgtccctctagttttgccttttgtggaatatcatgtaaatgattaaatatgaagtggtttgagtttggcagtcattgcatgcatataccttgaatttactttgtttatactctcatttatactaccaaccctccctagaaaaaatggattctgattggttctggttgcagtattacaaattccaaataaagctttatttgaggacccccaaa

SEQ ID NO: 1442 - DNA, 1978 bp, Homo sapiens
acgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtgcattccaggatgccttgaagattttctgtaggataaaaggtggtcgagtttcaactgatgacgtgtttgctgttttggatagcatgggtatccctataaaccgtgaaattttagaagaagtgacaaaacatacctatattgacagtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatggtgagtgttacaaatactaaaattaaaaagtataccaagatatt

SEQ ID NO: 1443 - DNA, 553 bp, Homo sapiens
agagagcgcgggggcctccagccgagaggaagggagggcagctcgggccggtagtgggacccttgggggacagagaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaat

SEQ ID NO: 1444 - DNA, 573 bp, Homo sapiens
aggacggaccgaaggtaagattgaagtggggtcagaccatggcgggacagcgcaccggagaatgaacagcgattagggaagagtggcgagcgggtggcaaggacggagggcggaatcccggccggggctgcgggaggaaagcgcacggacaggagccccaccgctcgaatgcagcgcccggcggctggcctcgtgaggtcacaggcccttacgagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaag

SEQ ID NO: 1445 - DNA, 1563 bp, Homo sapiens
cggccgcccgcgctcgccaccgagggctccgccggccacgcccaccccaaccggccgcgcgccgccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtgggtgccacagcccgggctgtaggtcgcccagcctttttttgggagcgatgggaaacaatgacatgaatgggatttagacgacaggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcaattcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtattaaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatc

SEQ ID NO: 1446 - DNA, 1420 bp, Homo sapiens
cggccgcccgcgctcgccaccgagggctccgccggccacgcccaccccaaccggccgcgcgccgccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcaattcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtattaaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatc

SEQ ID NO: 1447 - DNA, 1654 bp, Homo sapiens
cgccgcgcttcagcctcagcttcggcctcagcccgccgcagagggacgcggagcccggcgctgagccctgcgcgcgcgcctgccggtccgatctggacgaacgcgaggcgttctgcgagagcgaattcggtgagcccggccgccgcgccgccgccccgccgccccgcgagcctttccgagccccggagaatccgcccgcgagatcccagggcgcctgacccgtgcgggccgtttcgcggttgctaaaaaccacctcctgggggactgggagaggaactcggggtaatgctcttctccaaactgtttttcggaagcagcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtgggtgccacagcccgggctgtaggtcgcccagcctttttttgggagcgatgggaaacaatgacatgaatgggatttagacgacaggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcaattcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtattaaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatc

SEQ ID NO: 1448 - DNA, 1535 bp, Homo sapiens
cggccgcccgcgctcgccaccgagggctccgccggccacgcccaccccaaccggccgcgcgccgccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtgggtgccacagcccgggctgtaggtcgcccagcctttttttgggagcgatgggaaacaatgacatgaatgggatttagacgacaggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcaattcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtattaaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgttt

SEQ ID NO: 1449 - DNA, 4197 bp, Homo sapiens
acacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgaccgtgagtagtggtggagggggagtgttcattacagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcgc

SEQ ID NO: 1450 - DNA, 2827 bp, Homo sapiens
agccggctgggggagggggtgtcggcgcaccgcggagtcctgcgctccgtgagcctggcacccggagcagccgcctccccctccccctgcctagaccgctagaagccccctctcttccatcctcccggggcgggggtgagctgggctcagctgcccaaggcgggcggggcggagccaggagccccacggagcgctgcggagcgaacctcacctttccagggcgcaagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggatt

SEQ ID NO: 1451 - DNA, 950 bp, Homo sapiens
cggctaggtcacagaagcagtgggtcagaagccagaggggacgtggggagtgccaccctggagcctaccggcacacctgctgagatggaggcctcagatgggcaagggggtgaaggggacaagccactagagcaggtgacaaatgtgtcatgcctggagacaagctccagcgccagccctgctagagactcgctcatgcgccatgccaagggcctggatcaggacaccttcaaaacttgtaaagaatacctaagaccgctgaagaagttcctgcgaaagttgcacctgcccagggaccttccccagaagaagaagctgaagtacatgaagcagagccttgtggtcctaggggaccacatcaacacctttctgcagcattactgccaagcctgggaaatcaaacactggagaaagatgctctggcggttcatctccctcttctcggagctggaagcaaagcagcttcgccgactttacaagtacaccaagagcagccagccggccaagttcctggtgacattctgcgcctcggatgcgccggagaggtccttgctggccgaccgggaagacagtctgcccaagctctgccatgcatgggggctgcacagcaacatcagcggcatgaaggagcggctgtccaacatgcagaccccaggtcaagggagccccctgcctgggcagccaagatcccaggaccatgtcaagaaagattctttaagggagctttctcaaaaaccaaaactcaagaggaagaggataaaggaagccccagaaactccagagactgaaccgtaagaagaccaactgggacaaagggcccgcttgtcctggctctcagagcacggggaatggagaccaaaaagggaaaagaattgtccttatcaaaaagattctcaggtcttaattaggaataaatgaggtgggaaataaacattcttatgacagttcta

SEQ ID NO: 1452 - DNA, 2243 bp, Homo sapiens
gcttcgcgactgcggaaggttgcccgggctggcgccgctgggcagagccggtgcgacgtttccctttccagctttgttcttccggccctgctgtctgcctccccggctgattggattcgttactgctttgcaacgcgcacctaactccagacggggtctcactctgtcgcccaggctggagtgcagtggcacaatctcagcttgctgtgacctcagctctctgcgacctctgcttgctggactcaagcgatcctcccaccacctcagcctcctgagtagctggaaccatcatatgcaccagcacgcctggctaagctggaatgcaatagcgtggtcttggctcactgcaacctccgcctcccgggttcaagcaattctcctgcctcagcctcctaagtagctgggactacaggggccctcctgctgctccctccatgaggctggtcctgaaggaataggcctgtggctcgtccctcctccccatctcggccctgaggcaaacataccttccacagctctgggagcaccgcctccacccaggtctcacaggatgggacacaaggataggcattaagcaggacttccagggcccgagggaagttggcgcagtgtttcagcatctaggggtcaaaagagggtcttgggcacatgcctcccccacccgagggcagacccaagtcttgcctcacccacatggccaatcctagcctaatctggggggctaaggtctgagtctctcttcccttttttgtgcctctgtctaccccaccctcaagtatgctccaaccttttggccccagttttcctctggggctcttccctcccttggactctctctcccagaatcctctctccccctcccaagctggggacagccccctggccactgagggcaggctttcagtctcttggaccctctgtcttccccagaagcggagcagttccagccgcgggctcccccacacaggagcctcctatgtcagggcctcccagcgcacctcagggcgcactggctgcgccccgtagtccagcagtgcggcgaaaaggacttcaggctcccagttgggggagtcctggacggcctgcagcgcacagtccatgggcgtgtggcccgccccattggggacctcagcgcgggccccgtaacgcagcagcagctcggccaggcccccgcagccgttggcacaagcgttgtgcagcggcgtgtggcgcttgcgcccggccgcccgggcatcagctccagcctccaggagccggcgcgccgcagcctggtgtcgcctgcagctacctgggccctcggccccagcgcacgccgtgttcagcgcagtctcgccctggctggtgcgcaggcccacgtcggcgccatgctccaggtacagagccacatgttgctccaggccgcgcgccgccgccacgtgcaggggcgtctcctggctctcgcctgctgccaggttcaccgtcgctcctgcttccagcagcaacttggcgcacctggggacaagagagcaaggtcctgaggaaaatcctgaaggcttgggaccccttcagcttgctgtgacactcccttgcctttccacccctctcagcttgaggtcctacctggtgtcctccatgagaatcatacaagccccgctacagacaacagaattggaaggtcctgagagctaccagaagcatcttcagttttcatatgaaaaacttaagcccaggagtgatttgtgcagccaaggacacacagcaagttagtggctgcaccagaaatagtactcactgcctcagacagtccctcccacagtctactctgtctccaccccaaggtctggttctgaatcattcagttgtcagttgtctccttttttttttttttttttggagacagggtctctctctgtggcccaggctgaagtgcagtggtgtgattacagctcatgtagcctggacctcccaagctcaagcaatcctcctgcctctgcctcccaagtagctgggaccacaggtgggcagcaccacacctggctaattttttaaatttttttttatagagacagggtcttaccatttgccccagctggtctcaaacccctgggctcaagcaagcctcctgccttggcctcccaaagtgctgggattacaggtgtgagccaccacacccggccttatctcctaacattttgatagcacaaaattttgaaaacccacttctgtgtacgttatgaagcatagaaaattaaacagtatgcacc

SEQ ID NO: 1453 - DNA, 1974 bp, Homo sapiens
acttggaagcttctacctccagaagtccagacacctcccctgtacctctcgtaccacagaggacaggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggtacatcaaacccacatcaaaatgttccatctcccaatgagcaagctgactataaaatctgagatgcgatccaggcccttagagcctacccaggaccccctgaagtggcaaagattaagggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctcatcaaacagctgaaggagaaaaatgagggtcaaaggatggagactttgacggggctacgaatggctcttaactcctgggctgctgtctctaaagacaagaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttgctgtgaggcaggctgtggctcaaactgtggaagagctcaagttgaagcctacgatgatgaacttggtggaggcacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctctgtatatgaggcacctaagaccaatgtgaaggcagagcccacaaggttccagaaagagcctgagaacccagaagagttaactattcaagactttcgacttgcaaagctgaaccccttgtttattgcaaagtccatcaccaaagtaggccaaaagaaaacgcctgctttcccaccgtgctgctcgaaaccacgaaaacataggccacaggtcatagggccctggcagccaaggatcaagaaacagctccgggtccttgctgaaattgccaaataagtcaattctttgggcctactccccgactccctccctgaagatgcttctcaggctcccatgagaaaacaatctatacttatcttccgtgaataaacaagtgtcactctaccta

SEQ ID NO: 1454 - DNA, 2878 bp, Homo sapiens
aaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgggctgggaggcccctgtgaaggagagggtggggagggaggcatctagggagaggggtcccccatggtggctcccctccctggccattgttatcccaggaggagacactgtgggcacagggctaagtccaggtgtttgtattcgggctagaaaaggcaatgtcccaagtctctgctgcctgtcacagtccttcagccagggctggacctcaaccctgaggagtcacactgagttccagtgaccaccgtggtggtggccatgccactcatggttgctatggccggaaggcctggggcagcctcctccaagccgctcgcaccccgtaggtgcccatccgctgctggcgcaagtgctggccgaagatgaagcagagcaggacagatgtcacgaacagggacagcaacaccgacaccaccgtgactatgatgaccatctggctgtccgacacaggctctggggagggagggggcaagggtcttagacgtcctgtgatcccagttaccagggaccaaaagggagtggaagtccacccccaacccagacccccagaccccgccgcccgctcatgcatccagcagtcaccccagttgcagagatgagtggtgaatggtgtctgcattaaaattattatctggaaaaaaggtggcccagggctcaggctaccagctggacttctgtgtggctgtgagggcagatgtccccttgtcagcagccatgggaccagtgtgtagctgctggacaccgtggcctggagggtggcatggtcccagccaagccccttcttgggcagagctgagtgaacttcatgccaggctccctgtgtgccggccgtccagggtcaccaagcagcagagctctggggacctcagtgggggcagtcaggccaaacttctcattgtggaggggagccaaggccagggagagccgtcaaggtcatggggcttgatggtggccgaggaactagttgacctctcccgacctctggagcagttgaggtccaagctggggacttggaaagaacttcagggaagagggagagtaagagggaagcctcaggatgaagggtgggctcctgggtgtttgcttcccaagtgggactcaagatttttcttcccccgaggggctgaaagtgacttatcactcccaactccatccacggatcccccctcaccatagatctccaacatcttcggggctgagtgtttgtgaaagatgttgccaccgcgagacatcaagtccagcacagccaggcaggagaagttgcggtggccatcctctctgtcagccgtgctgttgaatgtggctgtggcctcctgcggagcaggggctgccttcccgaaggtctcatagtgcagagtctcattgccacggaacaggaagagggtgaggctgtccaggggctccacggtgggcaccctgcactcaatggtgaaggacttgcccacagccaccaaagtgggttgcagtgtcaggatgacctgccttggaggctctgcaggggacaaaggagggaggtctggtcaggatgggggtgcagtcccagcagcctccccctggccagggccatctcctgtcaccatggtgttccacggttggggaggaggtggcctggccggctccagtgcagagaggaagagggcagcagttgaggatggaggctggactgtgtggtagttttacagacatgatggtttccggtgaccaggtgtctacaaggacaaggttcagaaattgtacagccaactggaaagatataaaagtttgggtctgtctcctctccttcagaaatgaaatataaatttcaaacatt

SEQ ID NO: 1455 - DNA, 3127 bp, Homo sapiens
aaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccaggattcagcactgtcctgcctccagggaaagggaggtgagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgggctgggaggcccctgtgaaggagagggtggggagggaggcatctagggagaggggtcccccatggtggctcccctccctggccattgttatcccaggaggagacactgtgggcacagggctaagtccaggtgtttgtattcgggctagaaaaggcaatgtcccaagtctctgctgcctgtcacagtccttcagccagggctggacctcaaccctgaggagtcacactgagttccagtgaccaccgtggtggtggccatgccactcatggttgctatggccggaaggcctggggcagcctcctccaagccgctcgcaccccgtaggtgcccatccgctgctggcgcaagtgctggccgaagatgaagcagagcaggacagatgtcacgaacagggacagcaacaccgacaccaccgtgactatgatgaccatctggctgtccgacacaggctctggggagggagggggcaagggtcttagacgtcctgtgatcccagttaccagggaccaaaagggagtggaagtccacccccaacccagacccccagaccccgccgcccgctcatgcatccagcagtcaccccagttgcagagatgagtggtgaatggtgtctgcattaaaattattatctggaaaaaaggtggcccagggctcaggctaccagctggacttctgtgtggctgtgagggcagatgtccccttgtcagcagccatgggaccagtgtgtagctgctggacaccgtggcctggagggtggcatggtcccagccaagccccttcttgggcagagctgagtgaacttcatgccaggctccctgtgtgccggccgtccagggtcaccaagcagcagagctctggggacctcagtgggggcagtcaggccaaacttctcattgtggaggggagccaaggccagggagagccgtcaaggtcatggggcttgatggtggccgaggaactagttgacctctcccgacctctggagcagttgaggtccaagctggggacttggaaagaacttcagggaagagggagagtaagagggaagcctcaggatgaagggtgggctcctgggtgtttgcttcccaagtgggactcaagatttttcttcccccgaggggctgaaagtgacttatcactcccaactccatccacggatcccccctcaccatagatctccaacatcttcggggctgagtgtttgtgaaagatgttgccaccgcgagacatcaagtccagcacagccaggcaggagaagttgcggtggccatcctctctgtcagccgtgctgttgaatgtggctgtggcctcctgcggagcaggggctgccttcccgaaggtctcatagtgcagagtctcattgccacggaacaggaagagggtgaggctgtccaggggctccacggtgggcaccctgcactcaatggtgaaggacttgcccacagccaccaaagtgggttgcagtgtcaggatgacctgccttggaggctctgcaggggacaaaggagggaggtctggtcaggatgggggtgcagtcccagcagcctccccctggccagggccatctcctgtcaccatggtgttccacggttggggaggaggtggcctggccggctccagtgcagagaggaagagggcagcagttgaggatggaggctggactgtgtggtagttttacagacatgatggtttccggtgaccaggtgtctacaaggacaaggttcagaaattgtacagccaactggaaagatataaaagtttgggtctgtctcctctccttcagaaatgaaatataaatttcaaacattaaacagttgggtgatcacgttg

SEQ ID NO: 1456 - DNA, 3032 bp, Homo sapiens
aaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccaggattcagcactgtcctgcctccagggaaagggagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgggctgggaggcccctgtgaaggagagggtggggagggaggcatctagggagaggggtcccccatggtggctcccctccctggccattgttatcccaggaggagacactgtgggcacagggctaagtccaggtgtttgtattcgggctagaaaaggcaatgtcccaagtctctgctgcctgtcacagtccttcagccagggctggacctcaaccctgaggagtcacactgagttccagtgaccaccgtggtggtggccatgccactcatggttgctatggccggaaggcctggggcagcctcctccaagccgctcgcaccccgtaggtgcccatccgctgctggcgcaagtgctggccgaagatgaagcagagcaggacagatgtcacgaacagggacagcaacaccgacaccaccgtgactatgatgaccatctggctgtccgacacaggctctggggagggagggggcaagggtcttagacgtcctgtgatcccagttaccagggaccaaaagggagtggaagtccacccccaacccagacccccagaccccgccgcccgctcatgcatccagcagtcaccccagttgcagagatgagtggtgaatggtgtctgcattaaaattattatctggaaaaaaggtggcccagggctcaggctaccagctggacttctgtgtggctgtgagggcagatgtccccttgtcagcagccatgggaccagtgtgtagctgctggacaccgtggcctggagggtggcatggtcccagccaagccccttcttgggcagagctgagtgaacttcatgccaggctccctgtgtgccggccgtccagggtcaccaagcagcagagctctggggacctcagtgggggcagtcaggccaaacttctcattgtggaggggagccaaggccagggagagccgtcaaggtcatggggcttgatggtggccgaggaactagttgacctctcccgacctctggagcagttgaggtccaagctggggacttggaaagaacttcagggaagagggagagtaagagggaagcctcaggatgaagggtgggctcctgggtgtttgcttcccaagtgggactcaagatttttcttcccccgaggggctgaaagtgacttatcactcccaactccatccacggatcccccctcaccatagatctccaacatcttcggggctgagtgtttgtgaaagatgttgccaccgcgagacatcaagtccagcacagccaggcaggagaagttgcggtggccatcctctctgtcagccgtgctgttgaatgtggctgtggcctcctgcggagcaggggctgccttcccgaaggtctcatagtgcagagtctcattgccacggaacaggaagagggtgaggctgtccaggggctccacggtgggcaccctgcactcaatggtgaaggacttgcccacagccaccaaagtgggttgcagtgtcaggatgacctgccttggaggctctgcaggggacaaaggagggaggtctggtcaggatgggggtgcagtcccagcagcctccccctggccagggccatctcctgtcaccatggtgttccacggttggggaggaggtggcctggccggctccagtgcagagaggaagagggcagcagttgaggatggaggctggactgtgtggtagttttacagacatgatggtttccggtgaccaggtgtctacaaggacaaggttcagaaattgtacagccaactggaaagatataaaagtttgggtctgtctcctctccttcagaaatgaaatataaatttcaaacatt

SEQ ID NO: 1457 - DNA, 967 bp, Homo sapiens
aaccggcgccagccatggcctctggggcgggcggaagctggggtcgctccccaccgcagagcgcagtcccgacgacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccaggattcagcactgtcctgcctccagggaaagggaggtgagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtc

SEQ ID NO: 1458 - DNA, 565 bp, Homo sapiens
aaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgtt

SEQ ID NO: 1459 - DNA, 1647 bp, Homo sapiens
agtgcagtgtgggttggggccgggggtggggggcagaggggggtggcccaggtggccctaggaccccccctccatggaaaaccagctatggcataacaccgtgagatgttgcaatcaataccaagaaagcccccacgatgccgaggacatcttactcctgctgctgggcctcatcgttcttgtcaacattggcatcaacgtggcaactatgatgtggcatggactccagaacgccttagacaagatgattgattgggctactcagaaaaatgaaattcaggccagtgaaagtcccccaagtggtcccccagacaaggctcaggatgtccacatccactgcatcctggaccctgtgcaggtgaagatgtcccgacccacgcagtactcctctttctcctgccaccatttctccaaccatcacagtagcagtcttcttcgctgtgttcgtcgccgccgccgccgccaccgccgttgtcgccgtcgctgctgcaaccaccagcagcggccgcagaactacagacaaatcccccatagccactcagtcttccgtaacccacatcgcagccaaaagatgtcacaactacaccgagtgcctttctttgatcaggaggacccggattcctacctggaggaggaggacaacctgcccttcccgtatcccaagtacccacgtcgcggctggggcgggttttatcagagagcgggcctgccctccaatgtggggctgtggggccaccagggtggtatcctggccagtctgccaccaccctctctctacctgtcacctgagctgcgctgcatgcccaagcgtgtagaggccaggtctgagctgaggctgcagtcctatgggcgccacggttcccaatcccgactgtggggcaatgtggaggctgagcagtgggcctcgtctccaccacctccccaccggctgccccctaacccctcttgggtccccgtggggcacagcccttacccctcagtgggctggatgctgtatgactcctgggatcagcggcgtcgtggcacggagggctttgagcgcccccctgcctcggtgtcccggaacgcccggcctgaggcccagggctgccgggagcaccactccccacagtcccaccagcagagcctgcttggtcacgcctatggccagtcccaccgcagtccccacccatccacggaacccttgggctacagctcccaggacccccgtgaggtgcggcgtcgggcagctgactgggctgaggctctgcccgcctggcgtcctctgactacctctgcctccctcacggtgttggacgaggcctcccatcaacggaccccagctccaagctcagtgctggtcccccattcctcccagccctggcccaaagtccaggctgcggaccctgcccctcccccgaccatgtttgtcccactcagccggaatccagggggcaatgccaactaccaggtgtacgacagcctggagctgaagcggcaggtgcagaagagcagagccaggtccagctcactgccaccggcttccacctccaccttgaggccctctctgcacaggagccagaccgagaaactcaactgaccagcaggcggatgtggggtgtggggcagggcatggagggagaggaataaagagaaacagagtccagg

SEQ ID NO: 1460 - DNA, 1612 bp, Homo sapiens
ggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagactttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttctt

SEQ ID NO: 1461 - DNA, 1642 bp, Homo sapiens
agcaggggagcggtttggcggagacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaataacatgaattgtgaggcaaggggcctggagagtcacataaaatcctatctgagcagctggtttgaggatgttgtatgcccaatccaaagggttgttcttctctttcaggaaaagcttacctttctgctacatgctgctttgagttacactcctgttgaagttaaagaatcagatgaaaaaacaaagagagacattaacaggtttctgagtgtggccagtcttcaaggacttattcatgaaggcaccatgacttctttgtgcatggccatgacagaggagcagcataagtctgtggtcatcgattgcagcagctcccagcctcagttctgcaatgcaggaagtaaccggttttgtgaggattggatgcaagcttttttaaatggtgccaaaggaggtaacccttttcttttccgacaagtactggagaactttaaactaaaggccatacaagacacaaacaatttgaagagatttatccgacaggcagaaatgaatcattatgctttgtttaaatgttacatgttcctaaagaactgtggtagtggagatatacttttgaagattgttaaagtggaacatgaagaaatgcctgaagccaaaaatgtgatagctgtccttgaagaattcatgaaagaagctcttgaccaaagtttttgatcatatgttttgagataattgtatgatcaagttgtatatttaagtcttagtgtttgaaattgcagttataattgttcataggattgctatttaagatgatttgaaactcaatccagattttctttttgtattttaccaatttaacttaaataaaaatctgaagaacatcttcactgagtcctagatagataatgtatgtgagagttgtgaaattttagtgtctcactggccccataaattccacgcttcaggaagttgttgcttaaaaaatttcagagatgattttgtttgtggcttttctcaggaaaagcctgagtttgctgcagtatttagcaacttttcttctcagaaaaaccataatacttccttttcagtggactgtagcttcttaaaaaaaaaaa

SEQ ID NO: 1462 - DNA, 2470 bp, Homo sapiens
atgtcttgaaaaaccagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactcacctgggaggatgagaagcagcagagatggggacagccacatggtcctgtctcctctcctctccttggtgatcacaggtgtctggtgcccttcagggacttgaatccaagctcggaagtcaacaccgcaaacctactcgaatctccttcaagtctcttgctcacttcctgttacatctgtagctacttctctttttacatattaggagaaaagaggtgtcattctttgaaaagactaaggtacagtgtatgttgcaaggtgtgcccaaacttttgtgcatgtggaaaagaaaatgtgtccgggactggtcaggtttgcacgggagtgcacgtaggagccaaggagcaggaggagccaggaggaacccaagcattgaggagctgcgggatctactgcctggaggagaggacggacaaggccagccatgaggagtgcagggagaggagcactttgggaagaccacagtgcacaggactcacacccagccttgctggagaaagcccatgccccaggcttcttccaggcagccccactgtaagacatctcattgcctcttcctgccctgggctgtctgacccactgccccttcccccaggaacacttccactgggatcatgagtcactctgaagccactctgaaatcactctgaagccaaagctgggctcagtggggaaggtcaggaatggagaaattgccttttctcgttagcctcctcttgccctgatttcatcctccctatccctgcacactttcccctggctgctgttgtaatctacttgttctgctgacgcccgaactgacttctttcccggtctctccccactttctttagatggtcccttccctctttctctccctttccctcctgaatcgattcattttttctctcctgttttatattttccatatctgtgggctttgttctacatttggggagctttttatattgtttatttcatgcttgtactttcccttccaatccttggatcaaatattgattttagagactgtatttttatttcgaaaagtttttttggttctttgattactgatgttttcaaactctcttctgttccttgaactatatccctccactcagtggtcacatctttgttttgttgtctgcttcttctatattatgagccttcctcaagtgtctgctgattcttggttatccaatcatagttgagaacaagataaagtgtagctaactgagacctcagagtatgtaggagtaaatagtatataaaatagctctggtggctcatgcctgtaatccagcactttgggaggccaaggcggacagaccacctgaggtcaggagttcgaaaccagcctggccaacatggagaaaccccatctctactaaaaatacaaaaattagccaggtggtggcacacgcctgtaatcccagctactcaggaggctgaggcaggagaatcgcctgaacctgggaggtggagattgcagtgagcccagattgcaccactgctctctagcctgggcaaaaaaactagttccaaaaaagacacttgtacacgcatgtttatagcagcacaatttgcgattgaaaacatagggaaccagcctaaatgcccatcaagcaatgagtggataaagacaatgcggtgtacatatacaccatggaatactattcagccacaaaaaggaacaaaataatggcattcacagcaacctggatggagttggagatcattattctaagtgaaataactcaggaatggagaaccaaatattgtacatcctcacttataagtgggagctgcgctatgaagatacaaaggcacaagaatgatacaatggattttggggacttaggggaaaggatgcaggggatgagggataaaaaaccatacattgggtacagtgtacactgctccagtgaagggtgcaccaaaatctcagaagtcactgctaaagaccttatccttgtaaccaaaagccatctgctccccaaaaactattgaaataaaataaaatataaaaagaaagagaaagaaaagaaaatagttccaatttatcatgcc

SEQ ID NO: 1463 - DNA, 2525 bp, Homo sapiens
agtgccctaaagaggtactgggagcggcagcagatacaagatcagtgccctaaagaggtactgggatatcagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactcacctgggaggatgagaagcagcagagatggggacagccacatggtcctgtctcctctcctctccttggtgatcacaggtgtctggtgcccttcagggacttgaatccaagctcggaagtcaacaccgcaaacctactcgaatctccttcaagtctcttgctcacttcctgttacatctgtagctacttctctttttacatattaggagaaaagaggtgtcattctttgaaaagactaaggtacagtgtatgttgcaaggtgtgcccaaacttttgtgcatgtggaaaagaaaatgtgtccgggactggtcaggtttgcacgggagtgcacgtaggagccaaggagcaggaggagccaggaggaacccaagcattgaggagctgcgggatctactgcctggaggagaggacggacaaggccagccatgaggagtgcagggagaggagcactttgggaagaccacagtgcacaggactcacacccagccttgctggagaaagcccatgccccaggcttcttccaggcagccccactgtaagacatctcattgcctcttcctgccctgggctgtctgacccactgccccttcccccaggaacacttccactgggatcatgagtcactctgaagccactctgaaatcactctgaagccaaagctgggctcagtggggaaggtcaggaatggagaaattgccttttctcgttagcctcctcttgccctgatttcatcctccctatccctgcacactttcccctggctgctgttgtaatctacttgttctgctgacgcccgaactgacttctttcccggtctctccccactttctttagatggtcccttccctctttctctccctttccctcctgaatcgattcattttttctctcctgttttatattttccatatctgtgggctttgttctacatttggggagctttttatattgtttatttcatgcttgtactttcccttccaatccttggatcaaatattgattttagagactgtatttttatttcgaaaagtttttttggttctttgattactgatgttttcaaactctcttctgttccttgaactatatccctccactcagtggtcacatctttgttttgttgtctgcttcttctatattatgagccttcctcaagtgtctgctgattcttggttatccaatcatagttgagaacaagataaagtgtagctaactgagacctcagagtatgtaggagtaaatagtatataaaatagctctggtggctcatgcctgtaatccagcactttgggaggccaaggcggacagaccacctgaggtcaggagttcgaaaccagcctggccaacatggagaaaccccatctctactaaaaatacaaaaattagccaggtggtggcacacgcctgtaatcccagctactcaggaggctgaggcaggagaatcgcctgaacctgggaggtggagattgcagtgagcccagattgcaccactgctctctagcctgggcaaaaaaactagttccaaaaaagacacttgtacacgcatgtttatagcagcacaatttgcgattgaaaacatagggaaccagcctaaatgcccatcaagcaatgagtggataaagacaatgcggtgtacatatacaccatggaatactattcagccacaaaaaggaacaaaataatggcattcacagcaacctggatggagttggagatcattattctaagtgaaataactcaggaatggagaaccaaatattgtacatcctcacttataagtgggagctgcgctatgaagatacaaaggcacaagaatgatacaatggattttggggacttaggggaaaggatgcaggggatgagggataaaaaaccatacattgggtacagtgtacactgctccagtgaagggtgcaccaaaatctcagaagtcactgctaaagaccttatccttgtaaccaaaagccatctgctccccaaaaactattgaaataaaataaaatataaaaagaaagagaaagaaaagaaaatagttccaatttatcatgcc

SEQ ID NO: 1464 - DNA, 641 bp, Homo sapiens
ggcccttgttcactagaagcaaggagctccctgaccccttctttcaaaacagatctctttgtctttgtcttcatttctgcattcgtcccccctttgttcaatcccctagcaaccaacagcgacaagtggtggccgggacaggaacgtgagcaaagaaggtctgctggagcagagaaagagaaactgacaagacgaacgagaaaccctggaacaagtctgccggcagccaataaaagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactca

SEQ ID NO: 1465 - DNA, 1530 bp, Homo sapiens
cttcctcctccactcccccgccgctgctgtggagaaccggagccaccggtatggcctggccctgccctcccgaaggccgcagctcccgggcccgcctccccagctgaccgcgaactcctgcgtggggtgctcctggggcgggaggggcgcgctcagcctcgctctccccgggactctcacgctcaagcgccccggcttgaggccgggaccccctatttcccggttatgggacggccccttgagggacagcctctacgagccctggatttataccccgagcctgccttcctccgctctgggaaggacccaaaatccagtcccgcttcctccccctccttcgctgtccttggccccgaggtgcggagcaccggcggtcaggcgggatcccgcaggaggccgagcgctccctgctcgcaggacagggcggcagcggagggagcccccgccctcttgggaggaagcccgagctccgggtctcctgggcaccctcccgggagcgccttcggggtggaggctggttgccgggcgctgaacgtgtccgagcacgcccggggcggttttgcacttggacttccttttgggctctccggaggcgcatatctgttcctcctattggatggggccggggaccccaaacccactccggaagcaccgatttccagcgctgacggccgcgcctggtttcccagcgagtcctcttggcagctcccgcagctccccgccgggagcacgagtgggagcgaacccagagcccgcccaggcctcgggcctcggcaactcctcacaggtccacgagatggcgctgcaggccagggcccgggccgcggcctcacagcccgcctcgggcgagagcgggagatagactgcggaccccggcaagcggggcacggaggcacagccaccgacacaggcagagccgggtccggagcccggcacaggccgccgagggaccgagggactccggggctgcggacacactgagcggagggcttgaggctcggggtggggccttctcccctgctgccagaaccgcccggcagcgccagctcggcgaccttccaggctgctgcagaccccagcttgtcctcttctgcgcgcccgcggggctgggccctcgcgttctctctgcgggaagtgagccgccggcctccggcctcctgggcccctccgaagggggctgtggctggcatccgcagcgcgcggggcgcacggccctaggagcgcggggcccactcgacggtgaggacttacgggcgggataggggaaggatcggcggggatccagcgctcctccagcggagagggccccctcggctccgacccgccctcctcaccaccctcatccggctcttcagggcggggtcttcagggtcgagggcaggatgtgccctgtggagctgctcacctaagttcctgcctccataggggaggctttgggctgcgttattccagcgggaggtggtggggactggggagggcccaggggtcagcctgagaatctcgcccttggattaaaagccaccaatgctc

SEQ ID NO: 1466 - DNA, 432 bp, Homo sapiens
atgactaggatgactaggcccctcaaaagccatgttcaggtggtgccttccacgctcatgtggcagagccaggcgcgcacacagccagcaccattgtgctgcaagctcctgactcccaggtggctgccactgctcctgcctacacatcctcacagccactgtctagcaggacacctgtttttcccagcccgttactcctgtagctctgaatggaaacagcagctcacatgtcacctctgtgtgacggactcggccccacccagacacacaggtgtggttgtcagcgagcacctcaggagaactgagaagctctttttcaccattctttccccaaatcagtcaaaaccttttaaaacctggaaaatgttgaaagcaaccattcctatttttgtttgttttttattaaatcttgcacaaaatccccggcccctc

SEQ ID NO: 1467 - DNA, 3797 bp, Homo sapiens
agtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagaggagtctttgttaagaaacgatcttcgtccagctaacaaacttgctaaaggaaataggttattcatgagatttgctacaaaagccccaggtctaggatccatccaggactgagtgtatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaactgtattgtcccatattttgttgattaaccttgctttttctccctccctttagagagattagaggatataaccatgatatatttcagcttcttattaggattctaggaaagagatggttctggtttctctgccagttgagacttaagacatctgagatttctcagcttttctttccctgtgaagcatacagctgagagccaggttcttaggaagggtcagggtttggggagttggtagagtgaggagtgcgggggcctgagaatcggacacctggatgccaacccctggctctgctccatggacctgggcctcagttttcccgtctagcagttgagtgggctgttaccagaattcct

SEQ ID NO: 1468 - DNA, 3764 bp, Homo sapiens
agtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagaggagtctttgttaagaaacgatcttcgtccagctaacaaacttgctaaaggaaataggttattcatgagatttgctacaaaagatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaactgtattgtcccatattttgttgattaaccttgctttttctccctccctttagagagattagaggatataaccatgatatatttcagcttcttattaggattctaggaaagagatggttctggtttctctgccagttgagacttaagacatctgagatttctcagcttttctttccctgtgaagcatacagctgagagccaggttcttaggaagggtcagggtttggggagttggtagagtgaggagtgcgggggcctgagaatcggacacctggatgccaacccctggctctgctccatggacctgggcctcagttttcccgtctagcagttgagtgggctgttaccagaattcct

SEQ ID NO: 1469 - DNA, 3227 bp, Homo sapiens
ggagccagcggggaagaaagaaaccgagcgggcggaaggcgccctccccgccgcctgggcccgggcaccgggtgccgggcccggggtccttcccgcctcccgcggccgccggccgctttgtttcccctgcctctgcgcttcgggcgactcgagagggtctcccgccggggttgcgaaggggacgcggcggcagaagggcggccgaccccgccgggactcacagggacccaggagtccggccgccgggagggccgcgtgaggagagcgaagagggagcccgagctctgcggccccgggtggcgggccgggggcgcccgtgagcagagacctccccgtcgacggggggcgatgttcccctcacccgtgggctcttcgggcagccagggcatcccgccgctgggacctggacccgctcagtgggcacccctcaggctgctccatggagaccctgtgccctgcgccccgcctggcagtgccggcgtccccgcgagggtcgccctgctcccccacgccccggaagccgtgtcgggggacccaggaattctctccgctgtgcctgcgtgccctcgccttctgcgcccttgccaagccccgggcgtcctctctgggcccggggcctggggagctggcggcgcggtccccagtgctgcggggccctcaggcccccctgcgccctggcggctgggccccggatggcctgaagcacctctgggcaccgaccgggcggcccggcgttcctaacaccgccgccggcgaggatgcggacgtcgcagcgtgcccccgccgcggagaggaggaagagggcggaggcggtttcccgcacttcggcgttcgctcctgtgcacctccgggccgctgccctgcgcccccgcaccctcgggaatctacgaccagcttcgcctcggccccgcctcgcccggccccgggtctcgagcctcagcgtggcccagccgccagcccgcctcaggaacccagttcccggcctccgtcgccacctgcgggcctctccaccgagcccgcgggtcccgggacggcgccgcggccgttcctgcccggccagcctgccgaagtcgatggaaaccccccgccggccgcccccgaggctccagcggccagcccctcgacggccagcccggctccggccgcacccggagatctccgccaggaacatttcgatcgtctgatccgccggtcgaaactttggtgttacgcgaagggcttcgccttggacactccgagtttgcgccgggggccagagcggccgcctgcgaaagggccggctcggggagccgccaagaaacgccggctgccggcgccccctccgcgcaccgcgcagccccgccgccctgcaccgacgctccccaccacgagcaccttcagcctcctcaactgcttcccctgccccccggccctggtggtgggggaagacggagacctaaagccggcatcctcgcttcgcctccagggagactctaagcccccgcccgcccacccgctgtggaggtggcagatggggggtcccgctgtccctgagccccctggcctcaaattctgggggatcaacatggatgaaagctgaccgtgggacttctgccaaaggggaaaagttgggaccatggccaaaccgcgggcttgaggagggagccccgtttctcacatttgtccccttcctttacattttaggagctgtgggcagagggacctaaataacagtgatcttcattcaagcacctaagttttcggggtgacagtccctccccctcatcctttgcagaggaacccagggctggagtcgggagaaggctgatgacatagattccaatccctgcctccttccatctcggaccgttggaggcagggcctgcaccccagtgggagcaaaggaggccaccgctcaaagacacccccccacccaaaaaaaaggggagaagagagagacctcggtgatggacaaaccggttgttactgtgtctgtgggcgagcctggggtgcggggctgtggtgggggtggggagatgattggcagctccctgggggcatcccccacccccactgtccaggcctttaaccctttgctcccctcaggccttccctaacgctccaagcaccgctggagcctttaatgggtgagggaacttgggtaagaggaagatcacccccttcctgtcccctttctaggccccctcaagtgcaggtgacccttaattggtgagatcttcagcctcagccgccgacctttcccttttgtccagttttggagttcccgttttttccttgtttgctttccgagtgtaaggtctggccggtgagaaagatttcccccaaccttgattaatcagccccctcccccaacttacttcccttaggacgggtagggctgagggacctcctctcctggaaagtgcttactttgcctggggaaggggctagacactgtcccagggaaagtaatagaaggtggaagaaatcaataaaatcagaccaaacaagtcgcctttcgagggcctccaccgatttatggatgagagggggtggaggtggaaggcaggcccaagtccattctttggacacccaaactcagcccccttaaagagtggaaacaaaacaagctgcactttgcagaggtggtaaatgaaaggactcttggcctaacttcaagagtcccctggggtttgaaggggcaaagtttgagtctggatggaacctgggctgaggtaccttaagcttccccccgcaacaccccagcctcagggattgcgggagttgtcagagatctgatggatccgaaaggggcagggccaggggattaggtttggggtcagaggttctgttttccaggggaggggtgagataggcctggatcatgccctctgccatgccctccagctaggaggatcttgagtcagagaggattggaagtgctttctcctccacccaggtgaggtcaggggagcttaggtcttagggagatggcaagttgaggtatgaagggaagctggggcttttggagctgccgaacaactgagggacccagtgcgccttccatcccgcactagtgaatagcgccccctcttcccccgaaaacgaggtgcgagaggaacaattcccacgctggggaaggacttgtctccttttctgtgaaaatgctttgtaaaaagttgttattgtttgcatagagcagattcttgagaaaaactgttttggaccataaaagttttgtttgtttt

SEQ ID NO: 1470 - DNA, 1749 bp, Homo sapiens
agcaggggtggtcgccatggagacgcgtggccctggcctggcggtccgcgctgagagtcgccgattagtcggcatcgggcctcgggcgcccccggggcgggttgggttgcagcccagcgggcggctggaccgccgcggtggggcggggacaatggggtacaaggacaacgacggcgaggaggaggagcgggagggcggcgccgcgggcccgcgggggtctagactgccccccatcacaggcggcgcctccgagctggccaaacggaaggtgaagaagaaaaaaaggaagaagaagaccaaggggtctggcaagggggacgataaacatcagagtcagagcctgaagagccagccgctttcttcctcctttcatgacatcttaagtccttgcaaagagcgtggcccgaaaccagagcacagacagagcaaagtggaaaagaagcacctcccttctgactcctccaccgtcagcctccccgactttgccgaaatagagaaccttgcgaatcggatcaacgaaagtctgcgttgggatggaattcttgctgacccggaggcagagaaggaaaggattcgcatctataaactgaatcggagaaaacggtaccggtgcttggccctcaagggcttccaccccgaccccgaggccctcaagggcttccaccccgaccccgacgccctcaagggcttccaccccgaccccgaggccctcaagggcttccaccccgaccccgaggccctcaagggcatccaccccgaccccgaggctctcaagggcttccaccccgaccccgaggccctcaagggcttccaccccgaccctgaggccctcaagggtttccacactgaccccgaggccctcaagggtttccacattgaccccgaggccctcaagggcttccaccccgaccccaaggccctcaagggcttccaccccgaccccaaggccctcaagggtttccacactgaccccgaggccctcaagggcttccaccccgaccccaaggccctcaagggcttccaccccgaccccgaggccctcaagggcttccaccccgaccccgaggccctcaagggcttccaccccgaccccgaggccctcaagggcttccacactgaccccaatgccgaggaggcccctgagaacttaccctacctctcggacaaagatggcagctccagccacaggcagcccacgtcgaaagccgagtgccccaatctctgttttgaaggaaaccttaccccaaagcttctacactctgacttagctcctactctgctggagtgaaaatctacccacgacgctcacaaacttataattcctcctcaccacaagtttatgtgttaaaaaccatcatcataaaaggaaatgagacccgtatctgaaggaaacagatgttcggtacacggacgacgccgactctcccatcaccaagctgccctcggttgcccaggagagccacagtgccttgagaacataagcaatttagtgaacagagttcttttcagaatttcctttttcttaagtaagcatctctgttacttaatttctcaccacagctagatgtctataatctgccccaaaaagaaaagaaagcgtgtagatgatttacctcttaagtctcaatctcatggtgaaactcctcacacggtacctgcttctgttggccggaggacgatgccctgaacctcttggagcctttttctgttttaattaaatgcatggcctgcctttatatggcctcaaat

SEQ ID NO: 1471 - DNA, 590 bp, Homo sapiens
ctccgaggctacggtggttgggatggcgtacctgagcgagtgtcgcctgcgactggagaaaggctttatcttggacggggtggctgtgagcaccgctgcccgcgcttatgggcgctctaggcccaagctgtggtcggcgattccgccctacaacgcgcagcaggactaccacgcccgcagctacttccagagtcacgtggttccgccccttttgcggaaaactgatcaggatcatggcggtacaggaagggatggctggatagtagactacatccacatcttcgggcaaggacaaagatacctcaacaggagaaattgggcagggacagggcattctctccagcaggtgactgggcatgaccactacaatgctgatctgaaaccgatcgatgggttcaatggaaggtttggctaccgcaggaacactccagccctccgtcagagcacgtccgtcttcggagaggtcacccacttccctctgttctaacagcatcttttcccttcatagccatcgacctgaatttctaagacaaatgtttagatgaactcttagtgttattttacgttaaaaaaattaatttgtgtctcca

SEQ ID NO: 1472 - DNA, 984 bp, Homo sapiens
gccaggaactaggaggttctcactgcccgagcagaggccctacacccaccgaggcatggggctccctgggctgttctgcttggccgtgctggctgccagcagcttctccaaggcacgggaggaagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgctgggcgtcctccacctcaggtgcccatgtggacagtgccaggctacagatgcactgggagctgtggtccaagccagtgtctgagctgcgggccaacttcactctgcaggacagaggggcaggccccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaaaaaaaaaaaaaaaaaaa

SEQ ID NO: 1473 - DNA, 2397 bp, Homo sapiens
ggtgtatgtctaggcctggaattgttgagtcatatgaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgctgggcgtcctccacctcaggtgcccatgtggacagtgccaggctacagatgcactgggagctgtggtccaagccagtgtctgagctgcgggccaacttcactctgcaggacagaggggcaggccccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggtgagagggcccttggatttccagaggggcagctggcgcttctgtgccgggagggtgctagtgtccaagacacaggtcgatgggaagtgggacagctctacccggccactgctgagagcagagagggcacaggaggcaaccatgcccaccctggcccctgcctaaaggaagcccaacccagctgcctccgccccctcccaggagggttgcccagggcacccaccatcgtgctggttggcagccttgcctccactgcggccatcacctccaggatgctgggctggaccacgtgggccaggtaggaaatgggtgctcgatgcagggaggagggagagctgctgatggcctgagaggtccaaccgggccctggctgcagagctcaggtggtggggcttgcagggcagggctgtggccagggcaaagagcggccatcaccgcttacgcatgactcgaaggtgtttatgaggacctactgtgtgccatgtgcctactgaggcttacacattcaaggcgttatcggaccctgaccagtgctcccaggtgccctgtaacacagtctgctggcctctgggagggcagtctcctaagttctttatggggtctgagcagggattgcagggatgatgcctccaggagaccaaggtggaccaggagctcctgccttctgtgagaaccaccttgggcagtctttccgaggtggtggcaagagcctggggcccagcctcccagggtcccctctccaaggccatggctttactaacatgtaaagtgaccaaggcctttgtagtgtctgagtgcaggcaccacaggcctgtgtgctctgcctgtctggctttggtggtggccagccctgcctctgtgaactcatctctctttgtttgggagacactgccgtgtcctggttctcatcctctgcccgtggcccaggcccttacgtggctctaccaggagtctgtccttggcactttcccatctcacttctaccaagtctgttctttccagaagccagactcgtgggtgagccatgtcacctcgccgagcctcagtttttccttctgtaaaatggggtacagccttcatttagtggggtgagtaagcctcatgtctcttctgctggggcactgatgtgcttggcaccataaaactcccagaggcaggccgggcacagtggctcatgcctggaatctcagcactttgggaggctgaggcaggcgaatcacctgaggtcaggagttcgagaccagcctggccaacatgaagaaaccccgtctctactaaaaatacaaaattagccgggcgtggtggtgcgcacctgtagtcccagctactcgggagactgaggcaggagaatcacttgaacccaggaggtggaggttgcagtgagccgagatcgtgccattgcactccagcctggacaaaaagagcaaaactccgtctcaaaacaaacgaacactctcagacgcctcgggaggggatggctgggaggtgagcctgcctgacttgagtctccactgctttgtcaaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccac

SEQ ID NO: 1474 - DNA, 958 bp, Homo sapiens
gggccaagcccgctacctcctgtaagaggactggaggggaagcgggaggcgagcgggtaggtgttcctttgctcctcacaagtctctttctcttttacagctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattga

SEQ ID NO: 1475 - DNA, 1581 bp, Homo sapiens
tggtgcttgcacaacattgtaaatttactaaacgccactgaattgttcaccttaaaatggtcaatattacgttatgtgaatttcactttaattacaaaaagagaaacgctagcgtttacgcaggcggagggcaggctggactggggacgctcctcccggccgcctcgttgctggcagcgcttccgcccgccggcgcaccagtcagtaccgcgcccggcgaatgtggagggcgaagctgcggcagggcaatcacaaaagggctgtcagagaggaggcgaggcgggaggaagatggagaggcgggtgggagcctcacctttggactctatcgccacagcccggtctagccgctacgcccgagctcaagtctgactcgaaactccgctgggtgcctgagaggacccggcaggccaaggggtggaactgagggggcggggacgcggcgggcgggtggggccgcctcccggctgggcacgcctccaagccagactggacgcgaaggaaaccggaacctgtctgcctacggtgcctgtttccggaagcagcttgagtccggacaccaacgacggggacgctgggaagccgacttccggcgccctattttctcacctggttcccgcggcgagccagcggcagcggcggcggcgatgagacagaagcactaccttgaggctgcagcgcggggactgcacgacagctgcccgggccaagcccgctacctcctctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataagaaatgcctgatgtcaattctgaaactaaagttggtaaaacaactttttaaactcttattcattttttgaatacatggaaactagatctgaatgcaaacttttcttggcatccttcagtgtttatggggaaaatacctcattagtgtgaatacctgaaacctgcctacctcataggacagctgtgaggatcaaaaaatatatgaaagttccttgtagatacatatctatagatatatatgtgtatgtatataaagatagatatatacattga

SEQ ID NO: 1476 - DNA, 1581 bp, Homo sapiens; identical to SEQ ID NO: 1475

SEQ ID NO: 1477 - DNA, 5464 bp, Homo sapiens
tttccgggcggaagtgaggcgcccagcggaacggcctctggtgacattttcttgggggcggcgcggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccagatggacctccagttgtagctcattatgatatgtctgacaccaactctgacccagaagtggtaaatgtggacaatttattggcggctgcagtagttcaagagcacagtaattctgtaggcggccaggacacaggagctacctggaggaccagcgggcttctagaggagctgaatgcagaggcaggtcatttggatccaggattcctagcaagtgacaaaacatctggcaatgcgccactcaatgaagaaattaacattgcgtcttcagatagtgaagtagagattgtgggagttcaggaacatgcaaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcccccctttttttaattaaaagaagtcacttaggaaaataacatcacagagaaaagaatttcttctttccctcagtaggaatatagaatgatgaattttattagacaactttattttacttggtgacttttaatcttaggaaactctgccttccttttagaataatattttaattgccaggcaaaatgggtttcagtttttgaatcttgtatttatttttctgtataatgaaattaatatctagacttgaccactatctgcccaccccattggcactcccatcttagggcattcgcacacatatcagtcaggtccttattggcacctagtagggcatgtgcatttaaaaacttgtccttaaaaatagaagacagaagtattaaaattatattttcttttattttaagtcttctgccttctttcttgagtttgctcctgttgacttcccacagcacagataattgacatgtccctttgtgtttataaatactactaaggtgacctagttgttctccttgttgcaataattaataactctttgcaaaatgtctcctttgagacagaggcatttcagatagatacccaccatgaggtgttctgggcatctgaaggtattaagagttcagtgggaaaaatctctctccctcgcctttttttctggtttagtcaaataacgggtgaacatagaaacctgttgggaagaatatgaaaagttatgtggcctctgaggctacaggcacttgcaaatccgagaggaaagtgccgtctttcatagctggtctctgtataaagagtatgtagcaacaactgtttaacatccgagatgaagtggacctgatgctgtatttgggtatttttctcctctaccttctaaaaaaaaataccataagaagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccacctgcccagcctgttcttcttcttcttcttcatcttcttcttttttttttttttttgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgacctgttcttatgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaacaatg

SEQ ID NO: 1478 - DNA, 5281 bp, Homo sapiens
tttccgggcggaagtgaggcgcccagcggaacggcctctggtgacattttcttgggggcggcgcggacgactgaagggacttggtggtagaggctgcggaggcggcgaggttcactttggtcccggcaggggctctgaccgcgacccactgctcgctgccggggcttgttccgaggaggagaaggcggcggtggccgtcgcgtcctgagtcaccgcagcggggaagagtcccggccgggggttcggtgcgtgccccgacggggcgcgcgcgaagcgagcgagaaggcacggagtcgccgcggagcgcaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccaggtcatttggatccaggattcctagcaagtgacaaaacatctggcaatgcgccactcaatgaagaaattaacattgcgtcttcagatagtgaagtagagattgtgggagttcaggaacatgcaaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcccccctttttttaattaaaagaagtcacttaggaaaataacatcacagagaaaagaatttcttctttccctcagtaggaatatagaatgatgaattttattagacaactttattttacttggtgacttttaatcttaggaaactctgccttccttttagaataatattttaattgccaggcaaaatgggtttcagtttttgaatcttgtatttatttttctgtataatgaaattaatatctagacttgaccactatctgcccaccccattggcactcccatcttagggcattcgcacacatatcagtcaggtccttattggcacctagtagggcatgtgcatttaaaaacttgtccttaaaaatagaagacagaagtattaaaattatattttcttttattttaagtcttctgccttctttcttgagtttgctcctgttgacttcccacagcacagataattgacatgtccctttgtgtttataaatactactaaggtgacctagttgttctccttgttgcaataattaataactctttgcaaaatgtctcctttgagacagaggcatttcagatagatacccaccatgaggtgttctgggcatctgaaggtattaagagttcagtgggaaaaatctctctccctcgcctttttttctggtttagtcaaataacgggtgaacatagaaacctgttgggaagaatatgaaaagttatgtggcctctgaggctacaggcacttgcaaatccgagaggaaagtgccgtctttcatagctggtctctgtataaagagtatgtagcaacaactgtttaacatccgagatgaagtggacctgatgctgtatttgggtatttttctcctctaccttctaaaaaaaaataccataagaagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccacctgcccagcctgttcttcttcttcttcttcatcttcttcttttttttttttttttgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgacctgttcttatgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaacaatg

SEQ ID NO: 1479 - DNA, 1128 bp, Homo sapiens
gtcagctgcgtttccgcggtcgcgggtgagtgtgcccgggctagcggcctgggttgggctttgtagctgctccgcaggcccagcccgggccgcgctcgcagagtcctaggcggtgcgcggcctcctgcctcctccctcctcggcggtcgcggcccgccggcctccgcggtgcctgccttcgctctcaggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaactgg

SEQ ID NO: 1480 - DNA, 987 bp, Homo sapiens
ccctccggaagtgcggacattgtcagctgcgtttccgcggtcgcggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaactggta

SEQ ID NO: 1481 - DNA, 3087 bp, Homo sapiens
gaccgcagcagagccggaggggtgggcaggcgcgggtccgggagacgcgcggggaaacgcgcggagccgtgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttccctatcgtcttggcccaaataaaggctttgccattcagtactt

SEQ ID NO: 1482 - DNA, 3391 bp, Homo sapiens
ggcgcgggtccgggagacgcgcggggaaacgcgcggagccgtgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttccctatcgtcttggcccaaataaaggctttgccattcagtacttaaagtttgtgtaaactgtaacaatatctatgcccatgtgacactttgagacactctgtctaatgtacttttgtttttgtgtttaccagtcttttttagctcactgagagctgtctctctcaatcactcctcaatgttctatcttaattttgtggaagtttaaagttttcaatgagctggagatgaatgattaatgaataaatttaaatgcttcatttt

SEQ ID NO: 1483 - DNA, 1033 bp, Homo sapiens
tgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaataaaaaaaaaaaaaaaa

SEQ ID NO: 1484 - DNA, 2454 bp, Homo sapiens
atgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaactctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaa

SEQ ID NO: 1485 - DNA, 3354 bp, Homo sapiens
tgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttccctatcgtcttggcccaaataaaggctttgccattcagtacttaaagtttgtgtaaactgtaacaatatctatgcccatgtgacactttgagacactctgtctaatgtacttttgtttttgtgtttaccagtcttttttagctcactgagagctgtctctctcaatcactcctcaatgttctatcttaattttgtggaagtttaaagttttcaatgagctggagatgaatgattaatgaataaatttaaatgcttcattttgtcc

SEQ ID NO: 1486 - DNA, 3039 bp, Homo sapiens
aggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacaggttgcaggcttcttacctaagaaacttccaaactctctgccaattatatcagatgaactctcaaattttcagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccaga

SEQ ID NO: 1487 - DNA, 2302 bp, Homo sapiens
ttgtggaggcagagcgcgcggcggcggctggagctgcggccccaggatctagcggcgggagctgtccggggtgctgaccgccccgcccgccgcccgcccagcgcgccctcctgcaccggaccccgccaagtccggccttcttcccatcctccgtctgcctgtctttctctcttaatctgggggcgtagcggctggaagaaatcatggtgttcgctccaggtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaagtaacatggtggatttggctcttgacatgtgcttggtttctagccttcctcttagtataggacgcatctccaaaatgttgccagtaaagcaaaccgaagtgtcaccggcacctagctgtagaatgaattcacactagcccctggctgagaagcactgttttgaaaaagtgcattagacgattctgttcatatttatgcagtgcctctgagacatagtggggccaaatatgacactgtaattgcaaaagtagttttgcaggccaatttatttttaaagttcttttatttgaaaaaaagaattctatgtctcgtttatttacttctgccttttatgcgttccttctgtgaatttaacaagcagcctttttgctgaaatactgaatacagtactgagttctttatggtatattaaaaagacatgctagaaaggtgagggaatgcagttttagttaccttcaaatgtgaaattgaaggctttaagtgggttcaggtctaagatcaaattaagaaaagggaaattctaaggctgagtccctcgggaccataccaaggcatttactaatatttatgttattttaagaaagggaggagtttaagtttctcaagaactcagtcttttagtctcaattctctgaatgatttcataattggtgtttatgctctgtgtagaaatcttttgggaatattatggatttcttttctcaagattaaataaaataagacaagtgagtctacacatgtgagttgccaatgactcatttccttagcagcctcatggagaatggctagaagtgtagatttcttcaacagctgcctatcattaagagacttacacttggggctgattatggggtgcaacatccttggaagggattctggggtccttaacgaatgctgttttgccactaggctatgcatttgcattaggaccttactaacttttcccattcacacattaaattttttttttgagattatgaaaatcatacaggtcaggaatacatgagaacacaatggggacagtaaagtgacagtgttttgaatgcagtgacagagatatgtgtgtgtacacgtgtaataaagttatctgtgcagcaacaggatcaatccctgctccacttctgtgaggataatgcacatatttctggagtatctacagtcccatttcctgggcttcacaaaagttattgaattggtgctattggggacagaggaagaatttgaccttggttaaaaaccttctagtttcagagtatcaatatctacatttgatttttttttaaagcaaagtattcgggtataaattgtgactgatattaagatatacttctaaaattccaatatgctacagtttctagaataaatagttggataatagataatgaatgaaaaatatcttaccagctttgttatgctatctcccacagtgcacaggtggaataaattcacaggaaacatggaaggagaaggaagcagaagggcttaaaatttaaagattgtttactcacaagtatttcttttagcagaattcatgccaagtgaagagtgagtttaagtcgaccaaaagtcatataactgatgtgatataattgcatagcatacatagtgagaatgaaggtattcagggaaattattcaggagtgccacaaataaaataaataaataaatctaatgcttgtagtttgtaagtgatctggtactatgtctactcagatatctggatatgaccagcctttgtttttgctgtcaagtgacagaaacatataaacatactatttttcctctctgatgtgtctgtactaaaaaattgggaatttttggaacatcttattgacctctgtgtctaaatgttatttataaataaaacacatacagctttgaaatatcttaagc

SEQ ID NO: 1488 - DNA, 843 bp, Homo sapiens
ggaggaggggccaaagccaggactttgagaccggcgcgcggtcaagcccaggcagctctccctaaccctccagcactgggcaaacgctgcccgatgacgcccgcctcgggggccacggcatcactggggcgactgcgagcccggccgcggagccgctgggacgcggcttacctcccggctgtcgctgctgtgtgtgttgcccgcgccagtcacgtccctaatgggaccctccgtttcggcgtctgtaaggcgaggaggacgatgcgtcccctccctcgcaggattgaggttaggactaaacggggtccgcagcgcccggcagctcccgagcgctctccccagccgcgcctccctccttcccgccacccgtcccgcaggggcccgcggcgtcacctctcaggctgtagcgcgcctgcatgccgaataccgacagggtgccggtgcccgtgcggtcgtccttcctgacgccgcagcggaggatgtgttggatctgccccaggatttccaggtcccagatgaagagataattctacttactggatataggatgcattagatcttcttaccttaaaaaaaaaaaaaaaggcagcaatgatcaaaatactaataaattactcacagactcagtgtattttttcttggagtaaaagtccaggatgggtaatagaatacctgctgttggcttttggaaaaattggtactgtatgtagcaaaataatgtgaaacccatatgcatggatattcttaacaatttgaagaaatcgtcacagctttcctgggttgttgagcctctaagatggtcttttcctctgatgtgataataaagtgtttattctgaactct

SEQ ID NO: 1489 - DNA, 5065 bp, Homo sapiens
agcgtctcctgagggcagcgaggagggagctgaggcacgcgggctctcaatcgacgccccacagagaccaagaggcctggccttggggggcagctgcttgaaggaggcagagcggaagcgagggagactgctggaggccctgccgcccacccgccctttcctccccctgaggagacgcctgacgcatctgcagtgcaggaggccgtgggcgttagaagtgttgcttttccagtttgcctgattgctgagacactcagtcaggaaagtatgaatgattctaggcagcagtctctgttcttcatcacacttccagatttaaacaaactctgtgctgtcagaataatactgagtaataaggtggcagatactgagattaggactatacaaatgaagatgtgcaggcaattgctgtttttgcatcaagatattcttacatcacctgtgtctggaatattaaaccaaatctgggtggtgatggcgataccattttataaagcaagaaaacttaatgcctatgttgaaaaatatggagctaagatggaggctccacaaagagtaattcctgtaattcttcagaactgcctgtcatattcattcatggctagacttgctccagcctggaatagaactggtcatctcttgatacaaggaagagattttctttctcagatgggaaaacaaagtgctgttgtattaaacatcaatgtaacagaaactcaagtttgtctaagtatagaagcttgcacaatcagactgccagcacctgagctaaaagagtttgagatttcccagagtattataaaggattttcatgctaacaagcatgctgtcattgagagacattccattttaagcaactggtgctacgttttgccaagtatgaaaatgggacaaattataaatatttttcatgccatccccgctgcctgtccttttcactcatatggagatttccagagacactgggatgccctgtatggctataaacttccaggtgattgtggaaaaattaaaatatactgcaacatctatttcaaaatgctcggagaaaggaccttcacatatcctctcagttgcatcagaagtcagcccatgcagttctttccaagggtagattcggaagttgtgttgaaaagttttctttcagatttaaaatctaaactgccccatatatgtggatttcccataaagatgacaagtaaaccatgctactacacacaagaactaactaaacctaatatacaggaacacaaagtcaagccacccaatttgaccactaaaaaaatgcttagggcatctctgactcaagccacttccagaaagcctgcctgtgctcaaagtcttctaccatgttcagtagcagtggaccacaaggtggagctttcagtcagccagccaacatcaggcattttctcagctttgcatctccagccagagtctgttcagggtagaaagaaatccctgtctatcagggctccacaagtacattcagaagtattaatgcccaacagaggaaatactcaagttcagcacacaaatcttagctcccaaagcaacatcacccctaagtttgtaccagttttcaaaaatagattgttacaaatgaacaaaaatacctcagtacttggcagcccaaaaagaaaacagcatgatgtgacacaatctaaattgttttcactcaaaactagtatgatccagcatgacaaactgaatttaggtccagctataaaaaaccgttatagtagtaacattcagatgcaggctgctaacaatttaaatcaggagaattccagacctctgcaagaaaaaaatacagagtcttctgaaaatatgacaaaatttccctcttctcgtggaaaatcgactgtgagtttaaacaaaaataagcaactatctaatagtgcagtatttgtggtgtcaaataacaatttaggggtggtaaaaagtgctgttgacttccaaatgaaaggaaaagaaaatttaacaggcaaaggtataacacaaattttagggaaaagccatgggtcactaaaactgaaaagacagccacacatttttgaatcagatggagaaaccgaagatccacgactgctacagcagcaatcagaaaatcaagctaaagaagttggtacaagtgaccacaggttgatagtaagcaaaatagcccacaggtctaaaagaaaattatgtccagagtcttccaaaacttcaaagaagcatcattccgatactgtgcactatggccaatccagttcttctaagaagcagatacttgactcggataaatcaaaacttaagaaatctctcatcattcataatgcttagaacatggacctgaaagaaggaaatgtctaccagagatgagcattctgaatataggatgaacactcttccagatgcctctcacactcctgtgaccatgaaatcagctctacttactgctgtggaacctcctttttcacttgacagtttctttttattgtttgcatagcatcttgttgtatgtgggtttctgtatttaactagtcccctattgatagacacttcagttcttcccaacttttcactattacaacatcatgtagtctgcagatctttgcaaaatatccaatgatcttatacagtagttttgatagttgaaaatatctttattttgcccttattgaaattatcaaaccacataaagcacagataagagtatgaagaacctctaagtacctatcacccagatctaccagttattaatattttgccactgtttcatctgttcctcacagacatgcttttttttgctataatcttttaaagcaaattcaagacatcatataattttacccataaacaccaaagtgtatatatttctaacataagatatagtatattttttaagaaaaaaagaatgtgtatatatatattacattttggggatctctactatatctctgcaggctcactaaatttcacttttgcttttatatgcaaattaacaggaagccctgaataaatgtaaaagctatttctcaacaaaactggagcctttattggggtggagatttctgtttccaccagtactcattagcatcttctgtgtgccaggcagtggggacaacactgtgtccatggcagaaatggatgagacagccgtggcctgagcccctgagtgctggtggtctagtctcaagcaaattcattctgggttcctggcacagacttagggatatgtatgtattgaagcatatgtccagaatgaccttctagtccatattacaaataaattatctaacatttgaaaaaaagagaaacagaagtggagcttctcagacaatgaatattattctggctttcaaacattttatatgtttgatatacgaaatattatataattgttgtaatatatttaaaagaaaccaaaatcttcattggctattccactgaaacaataattacataaaaatagccactagagatccaagtataagttgaactctgattttgtaaatgtgatttattgtctccaccactttactaaaccattgcaattaaaagcaaaagtaaacaaactctccttcaaacgttaaatgttaactcctgctcctgaaattgtgtttagttaattaatttgctatatacctttattgtaagcatttctgttttccagaattatctctatttcccaattattttaccattttcataaggataagcattttgtctgaagcccattttgagtgtgcttttctcattccaaagtttgtattatagatatctagtagactgttataaagagtggtatgtcattttgtttatgaggctatggtgaaaataacattagtaaatatgcatttttgatgagcacagtcatccacagcatgtaatcattcctaaaaccagccttccccactgttccatacattcccaggccaccttcctgctactgcccagtcactatgcctcaggtaatggacacttactttattattacactgagcaaaataatgaaaaccatacatccactgctgaagtggtattaacatcttccagttctttatataaataatcttgatagcccctcctatactccattagtgtctaaaatttagaatatatagtatagtacttgagtttagatcaatgttaacctacatggcaaaacctgccatgtttagtgtatttttttgtataaagtaggtttgatttttatcttacaatatttatcctaatgaaagttataaaaatatatgcatatatttatatgtgagatttaatatagataggtatatagattgttgatttcatatttcatgttccaagaagaggttctagatcaaatttctgtgttcagaatcaccagagaaatcaattaagattttggttcattttaaacattgcaatttttgaaagccaagataattccaaatctaattagggaaagctacattttacttctttgtgtaagttattggtgatttatatgcagtatggaccatcctccccccagaaattattcttatattccaattgtgcattagttttagaaccattttaattttaaaaccataagaaaataattttatgtttgcctatgtccaggagctgaagaaatcagcgattactttaaaaaatatatggcaatgtcaaaataaatgccaagaatcatatttctaggaatgcaaaagtgcttctcatatactcatatattaggtttcacagtattggttgcttactatatttgtttttatttttattatatatcataattacacatttttatttgcatttgttgcttattgtagtaaaaaggtaaaaaaaaaatgaacttgttaatgattagcttttatttgactaaccagttgaccaattttgctctgttttcaaattgcatatgatggggtattatgctgaaactgctaatatattgggtatttattgatacttaggaatagtcagtatttataaatatttaagaatgtcatggtccttatgttttgatgtttaaaatgttcactttgttgtacgttacatagtgtcttattcaaaattgaaaataataaaggtatttctaata

SEQ ID NO: 1490 - DNA, 2173 bp, Homo sapiens
ccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaa

SEQ ID NO: 1491 - DNA, 2002 bp, Homo sapiens
agccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaact

SEQ ID NO: 1492 - DNA, 1944 bp, Homo sapiens
gcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctc

SEQ ID NO: 1493 - DNA, 1945 bp, Homo sapiens
agccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttaggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactat

SEQ ID NO: 1494 - DNA, 2851 bp, Homo sapiens
cagactgtggagccgggagccggcagtaagcccagaggtctccaccccacgggaggaaggctgaggccaagaccccggaagagatggaccgcgtgaccagataccccatcctgggcatccctcaggcacaccgtggcaccggcctggtgctggatggagacaccagctacacataccatctggtgtgcatgggccccgaggccagcggctggggccaggatgagccgcagacatggcccactgaccacagggcccagcagggcgtgcagaggcagggggtgtcctacagcgtgcatgcctacactggccagccgtccccacgggggctccactcggagaacagggaggatgagggttggcaggtttaccgcctgggcgccagggatgcccaccagggacgtccaacatgggcactccgcccagaggacggggaggacaaggagatgaagacctaccgcctggatgctggggacgctgaccccaggaggctgtgtgacctggagcgggagcgctgggccgtcatccagggccaggcagtcaggaagagcagcaccgtggccacgctccagggcactcctgaccacggagaccccaggacccccggcccacctcggtccacgcccctggaggagaacgtggttgacagggagcagattgacttcctggcagcgagacagcagttcctgagtctggagcaggcgaacaagggggcccctcatagctccccggccagggggacccctgcaggcacaaccccaggggccagccaggcccccaaggccttcaacaagccccacctggccaacgggcacgtggttcccatcaagccccaggtgaagggggtggtcagggaagagaacaaggtgcgtgctgtgcccacctgggccagtgtccaagttgtggatgaccctggctccttggcctcagtggagtccccggggacccccaaggagacgcccatcgagcgggagatccgtctggctcaggagcgtgaggcagacctgcgagagcagagggggcttcggcaggcaaccgaccaccaggagctggtggaaatccccaccaggccgctgctgaccaagctgagcctgatcacagccccacggcgggagagagggcgcccgtccctctacgtgcagcgggacatagtacaggagacacagcgtgaggaagaccaccggcgggagggcctgcacgtgggccgggcgtccacacccgactgggtctcggagggtccccagcccggactccggagagccctcagctcagattccatcctcagcccggccccagatgcccgtgcggccgacccagctccagaagtgaggaaggtgaaccgcatcccacctgatgcctaccagccgtacctgagccccgggaccccccagctagaattctcagccttcggagcattcggcaagcccagcagtctctccacagcggaggccaaggctgcgacttcaccaaaggccacgatgtccccgaggcatctctcagaatcctctggaaaacccctgagcacaaagcaagaggcatcgaagccccctcggggatgcccgcaagccaacaggggtgtcgtgcggtgggagtacttccgcctgcgtcctctgcggttcagggccccagacgagccccagcaggcccaagtcccccatgtctggggctgggaggtggctggggcccctgcactgaggctgcagaagtcccagtcatctgatctgctggaaagggagagggagagtgtcctgcgccgggagcaagaggtggcagaggagcggagaaatgctctcttcccagaggtcttctccccaacgccagatgagaactctgaccagaactccaggagctcctcccaggcatccggcatcacgggcagttactcggtgtctgagtctcccttcttcagccccatccacctacactcaaacgtggcgtggacagtggaagatccagtggacagtgctcctcccgggcagagaaagaaggagcaatggtacgctggcatcaacccctcggacggtatcaactcagaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgcc

SEQ ID NO: 1495 - DNA, 525 bp, Homo sapiens
gcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctga

SEQ ID NO: 1496 - DNA, 1410 bp, Homo sapiens
cggaatcggaagtggctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaaggtagggggagcccggtcccggggaaaagcggacctgagaccccggcagcaaggggacgggagagaagcacacccctaactcctgaccccacgccctgggaacccccgcaacatgggcacgaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtg

SEQ ID NO: 1497 - DNA, 2254 bp, Homo sapiens
gcggtgctccgaccggaatcggaagtggctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcgg

SEQ ID NO: 1498 - DNA, 2564 bp, Homo sapiens
gcgcagcgggggcggcgggccggggaccgggcagcaccgggcgcgcggagcgggcgcgccgccaacgcggtcacgtgcgcggcccctcctctcgcgccggcctcccccgcgccgcgctctccattcataaattctccgcctgctccgcggccaccgggcgccggagccagccgcgagcgccacgcagccgcccgccgccagcccgccgcccatgggccgctcgtcccggcgctgagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccagcccccggggaaggccctcaccggccgctctgtgggccccagctccgccctgccaggtgacccctacaactcagccgcgggcgccactgacttcgcagagatcagcccctcggcatctagcgactctggggaaggcacctcgttggatgccggtaccaggagcaccaaggctggagggcccggggctgcagcagggcctggggaggcgggcccgggatccggggcaggtaccgttctgcagttcctcacccgcctgcgccgccatgccagcctggatggggccagcccctatttcaaggtcaagaagtggaagctggagcccagccagcgggcagccagtctggacacgagaggttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggtatttttcagtagatggaggtgctaggggtggacctgtgggcccttgccccccttcgcccccccctaggcggcccagggagcgctctccaggccccgtggacacgcgctcgcctgcctccagcggcaaggcccctcccagaggcggactcactggggccacctctccagcatggaccagaggagggaagcagggagagactgggtaagggtagggcggtgggtggggaggaggggccccccgaggatggcgctggtactgctgcttgctggtggagtccgaggcctgaagggttctgctgtggtcccaggccctctcccacccccgccccgcccatgctcccaaggctgggcagactcctctcagaagctgctgtgaccactccggccagcagcacccctcccccaacccaagggcaacttccctgaagcccagggcccacgtcggtgggatgggaatggggcgtggggctggggcagagcagggttcctggggcagccctggtatggcgggtgaccctcacgtctgtgcactgtcctcctgctggttatccagcatgggtgggcagagagccctagcctggagcaggggctgagctggactcaaccgcgtccagtccatcccctgcggctcccacgtccactgggaggctgggaaaacgtgactcccggagagaagcatgttgacttttcctgggggcttccaagggagggggccccgccgtctgcagtccagcatggaggcaccctgcttaataagcaggcgccacagctcagggtcaatgcaagacgcatcccctgcaaaacacactggctcattttaaagctctcaccttccaaggcccgcccgagtcccaagtcccacccgcgtccaccctccctgatccagaggcgggatggccggccgggtagggggcgcggggctcggcggggctctgacggcgcggcctggcttgcaggctagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgc

SEQ ID NO: 1499 - DNA, 2570 bp, Homo sapiens
ccaggtcagacccctcctgcgaggccaggggctgtggccattgggagtttgtccccacggacccctcctcccccagagggcacgccagtcttgaagcaacatgagcagcccggagccccccacagagccccccgagcccgacaaccccacctggtcgactcagcccacgtatagcaaccttggtcagatccgtgcccacctgctgccctccaaggcctgccgcctccggacccctgggtccctctccaccaacccagagcccctgcccccacccctgcccaagaagatcctaacccggacccagtcactgcccacccgcaggaccctccatcccagctccatccaagtacagccgcctcggagaccctttctggggtcccacagtgtggacaagagccaggctgcagtgggaccagcctgtctccctgcagagctgacctttggcccggctgacgccccactgggcctctccctccgcgatctgcacagcccggaggctgtgcacactgcactggctgcgcggcagctgcagggcctccgtaccatctatgcccggctccgtgcccggctcatggggggccaccccgggccctgccaccccggccacagcttccgcctcctagacagctcaccctgcgcagagagcggggacgccctgtattaccgcgtggtgcgcgcgcacgaggacgcctggcacatcctggtcgccaaggtgcccaagcccggggcggacgtgccccacccgtggggcctggagctgcaggcctccctgtctccacacttcaatctgcaggggctgtgtggcctggtgcctgaaggcacactgcccggggcgccctggagaggcgcagtggcgctggcagccgaggttccagagcgcacggtggcgcagtggctggcggaggcctgcacgcagccgccggaggagttcgtgtgggctgtggccctgctgctgctgcagctgagcgcggccctgaagttcctggaggcgtggggcgcggccctagtcgagttgcggccggagaacttgctgctggtggcacctcggggctgtgcgacgacggggcccccacgcctgctcctcactgactttggccgcgtctgtctgcagccccctggacccccgggatccccgggcccccacgcgccgcagctgggcagcctcctccgagcgctgctcagccttgctgcgccctcgaccacgcctttggccgcgggcctggagctcctggcagcacagctgacccgcttgcggccctcggcgtcccggacgcggggcgcgctgcaggcgctgctctgggggcccgggcctgagctgcgcggccgcggagcaccgcttggtccctggctccgagcgctcgggccctggctgcgggtgcgccgcgggctgctggtcctgcgcctagcagagcgggccgcaggtggggaagctcccagcctcgaggactggctgtgttgcgaatacctggccgaggccaccgagtcctcgatgggccaggccctggcgctgctgtgggactgaccccaacccagggcgaacacacctggtccaggcctgcccaggaggcagggctggggctgaggtcagcgtctccatgatagccaagacaccctcttcctgcagagtccaggagcgcagcagagagagcaatgccccactccagagcctcccctcccgtgctggggatgtgggtcaagggcttcccaggaatgcagctgcccctccagggctgggggctggccagcgcctcctgtgttgggcagcagctctctgaagccagggcccccacgccacttccaggtgtggacaaccccgctgatcaatgtctctctgtgttctgccttccccagcagccagggcgctcttccgcgtgggttctgtcattgtctccatgagaggccaatgccgggaccagaggcattcctggctctggagcacccccttgtgctgaagatggccagtgattttgggcatgtgaatgcccctgtccctggtggagaattgcttggtggtgtcacgggaagggaaggctccctgggaccttagacacccagctcatctcagcggggtctggactcaccttccctaaaacagtccccgcggttccctgccacctcccctcaatccctctgcgcccaccctgcctccctccctgttcctccgtgacacaccaacttctttcgcgcccccaagcatttgtgtaggctgttccctctgccatactgttccagttccactttctttttcttttttttttttttttttttttgagacgatctcggcttactgcaagctccgcctcccgggttcacgccattctcctgcctcagcctcccgagtagctgggactacaggcgcccgccaccacgcccggctaattttttgtatttttagtagagacggggtttctccgtgttagccaggatggtctccatctcctgacctcgtgatccgtccgcctcggcctcccaaagtgctgggattacaggcgtgagccaccgcgcccggctacagtttcactttctctaaacaaataaaggtgcccactctgggccatcgctagctcctt

SEQ ID NO: 1500 - DNA, 2763 bp, Homo sapiens
gcttccggttctgacggacgcttcggccgtaacgatgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgaggtgtgcatggtttcccagccacgtccctgttttcaaagatagtttcactttggtctctgaattgaaatgctgtctactgaaagggtttcaggagcgtttatgtaaggggctgtgatgaaattgcattccccatagataaaagaaaaatcatttctatccagagatctgagcagaaggattggcttgttagtttaacacagccgtatttttggacattcagtgttacttgctgagtctgacagcctctgggcccggccaggggccctgttaacaaactgctttcacatcccaacagggtctgcttggccactcagtgcagctgcgattaaccctaaaggctttaaggaacgggccacctgtaacagagacaccagccttcctgtatagacactaaattgttagcaagagtgttgagctagttcctggtgaagtgtttccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtctggtttttttgtttgtttgtttataccaataagaatgagcctgaatgttggtggtttttgaaatcctgacttggaggtaaacctggaggaaggaaaaaaagtaaatatgcaggcttttaggactgagtagccttgaaaataaacctcatttctaaaaaggaccttttgtttatactttttttttttttttaaccaagaagtcaatttccaacctgagtccttttgaatttaccctgctggaaaaacctaggattcattttggaggccatgagaaagaaaagagtcagtggtagagtttcctttttggatttagctcaataaatgatggtcaagaattgggcaagtggggctgcgcgcagtggctcatacctgtaatcccagcactttgggaggccgaggtaggcggatcacttgaggtcaggagttcgaaactagcctggccaacatggtgaaatcgcatctctactaaaaatagaaaaattagccagatatggtggcacacgcctataatcccagctactcgggtggctgaggcacaagaattgcttaaatctgggaggcggaggttgcagtgagctgagattgagccactgcacttcagcctgggtgagacaatgagattctgtctcaaaaaaaaaaaaaaaaaaagaattgagtaagtggaattttgactggagctgctcctgaaagtattgaaagagtcattgctaatggtgggctcttgctagaccagggtcaagtccacttttgctgcctctcaggttgtggaattctccttgatcacttctgcaattcatttccttgccaaatctcagccaagcatcaccccaaggtctgtaagtagcagagatcggagctgctgggtctggctttgctgaggccggtgtcgctgtcagaacaggcacgccaagatcttggctgggtccctcacaggccagatgaatggtgtgaagaaaccttcctgccttattcagactggcgcggaggtctcaatgaggcgaggcatttgtccattatggggatgaatcgtgctctcagaagagaatcctgtcattgaggttttgtttcaatagtcctctttttctccagagaactgttgtctcattgttaataatagcagcgtggctttttcagatgctggttggtggctgctgtacattttaaaaatggaatctcatggttgtgtctcttaaggaagcttttcaagaactttactggcaccagaggttatcagagtttgaagtttgggtgcctagtgtctcacagtgtttaagcactaatgttctgggtcagttaggtgtgagtacaaatcccatctcagctcattctgagagggaccttggctaattgctttctcctctccaagcctcagtttccacatctctaaaatcggcctgcaagtagtgtgtgcctaaggttgttgtaagtttcaatgaactcgaatgcggctgagtgcctgagagcacctgttgctgtgggtatcatcaccgtgtgtgttttctgtcttctcatccacttttctttgtgcagtctgcacacacaccattaaaggctgatgacagca

SEQ ID NO: 1501 - DNA, 909 bp, Homo sapiens
ccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgg

SEQ ID NO: 1502 - DNA, 1679 bp, Homo sapiens
ggatgcagcctgggaaggaacatgaggatcctctgagagaccagggacagagggagacccaaagatctggtctgtagctaagtgaattttctaaaactcattgattcacacgccatcccttgaggtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcgggggccccaacaccctcaagtgggactacacgagacaagatgggacttcctaccaaagacagttccaggccctgccaggcccacctgccttgaggtgtaagagggcctcctccggagtggagctgggagactgcaagatcagctatggatcaacgtgttcggagcagaaacaggcctacaggccccaggatctgcctgaagataggtatgacaaggcccaggccacagcccacatccactgtgtaaatatccgtcctggtgacggcctcttccgcgacaggaccaccaaggccgagcacttctatgccagggagccagagccttttgttcttcaccacgatcagactccggagtcgcacatcctgaaaggaaattggtgccccggccccggcagtctggacaccttcatgcagtacttctacggccagccgccacccccgacccagccacccagccgccacgtgcctcatgagaaattgcagagtcatgtgaccctaggggagccaaagctactcaaacgcttcttcaagaccaccatgggctcggactactgcccttcagagtggagacaggtgcagaaagcgcccaacctccacttgcagcaaagctacctgccgcggggcacgggcgaattcgattttttaaccatgaaccagaagatgctgaagccacacagaacacctccggccccggtgactgaagagatgctacagcggtgcaagtacagccacatggagccccctctgggtggactgcgcttcttctcaacacaatacaaggacgagtttcctttcaagtaccagggcccagcagccctgagactgaaaaatcctcaggagggcttcgtgcccctgggcacgcctcaccagcgcggctgcagggagaagatagaccctctggtcccccagccccctatgtacctgtgccccagccagcaataaatgccatcttggcaacattc

SEQ ID NO: 1503 - DNA, 786 bp, Homo sapiens
acaccctcctggacacttcctacccatgttacctgctggtgacctgtcttgttcatggctatatccgcacagcctggcagaaaacagagaatctgttttgtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcgggggccccaacaccctcaagtgggactacacgagacaagatgggacttcctaccaaagacagttccaggccctgccaggcccacctgccttga

SEQ ID NO: 1504 - DNA, 833 bp, Homo sapiens
ccctgagcctcaatgtcttttgtgaagcagtggttaaaacctacccttggccaggcatggtggctaacacctgtaatcccagcactttgggaggctgaggcagaagggttgcttgagcccaggagtttgagaccagcctgagcaacatagccagacccctgtctctaaaaaaaaaaatagaaagaattagccatgcatggtggtgcacacctatagtcccagatgctcagaagactgaggtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcg

SEQ ID NO: 1505 - DNA, 2085 bp, Homo sapiens
atggttatggccgcactctcgctggtggcggcctgttggggtagagcggccgcggacgagtcagttcagcttccggcggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttc

SEQ ID NO: 1506 - DNA, 2123 bp, Homo sapiens
gacagttggcgccgccgggagggagggcgggcggcgcgagtgggcgcgggcccggtgggccaggctccagggagcagtgtcagggccagggagacgatggtctccgtgactatgggtgagtctgtggccttctctccagggccccctctccccactgccctttttgagccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttc

SEQ ID NO: 1507 - DNA, 3628 bp, Homo sapiens
gggcggtcacgtgatggttatggccgcactctcgctggtggcggcctgttggggtagagcggccgcggacgagtcagttcagcttccggcggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctgagccaggcctgtcctaggagctggtagcaggtagtgagcagggcctctccagggatggggtgtaggtaaagcggtggtgctggccaaggaatctgaggagtgggagaaagtggccagggccgcttcagtggttgtggataggaaggccttgcagaaggggtgacatggaggccaagttgggaatgtggcttcatgaagttcaggaggagagctttcagacagagggacagccaggggcagaggtgctgaggtgggacaaggaacaggaagaaggctggtggctgtgggtgagggtgggccctgcctccagcatgaggcagaggtgggtgggcaggggctaggtggctgggggtgttgtgatcaaggaggaggaatgtgcacagtgacccgggagtgctggatcgggaggatttggagctgggatgtgctgagctgagtttcatttaggatcatcgctctggcttctgtgaggagaaggaatggctgggagggctggggtggatgccactgcagcagtccaggcaggaagccaggatggctgcgagggcatggcagtggggagcagggaagagggccgcttgggctgcttagggtgtgctttggaggaagagctgtgggatgtgctgatgggttggaagttggggctagagaagatgagaatcatagggcccgcctagatgttagaccggagcatctgggggaacggctgttaacagagaaggggagacgggaggaaggtcaaggaagagggagctgtgttctgactgcattgcgcctgttagggtccccgctggggctcaggcggacacctgggctgggggttcatggctgctgacagtgcgcagggtacagctggaatcaaagccaagggccttggctgggcgtggtggcttacgcttgtaatcccagcagtttgggaggccaaggcgggtggatcacaaggtcaggagttcgagaccagcctggccaagatggtgaaaccccgtctctactaaaaatacaaaaattagccgggtgtggtgacaggtgcctgtaatcccggctacttaggaggctgaggcaggaggatcgcttgaacccgggaggtggaggttgcagtgagctgagatcgtgccactgcactccagcctaggcaacaagagcgagactccatctcaaaaaaaaaaaaaaaaaaa

SEQ ID NO: 1508 - DNA, 1503 bp, Homo sapiens
aaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagctttt

SEQ ID NO: 1509 - DNA, 1666 bp, Homo sapiens
tgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctgggagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagctttt

SEQ ID NO: 1510 - DNA, 2226 bp, Homo sapiens
atgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagggatgctacggtggacgctctgccaaccaccatggtgccccagccagctgtcatcttgccaggtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagccccgaccccggaatctttcaccgtccacttcctgccgctcgattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 1511 - DNA, 2167 bp, Homo sapiens
cacatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcgattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacc

SEQ ID NO: 1512 - DNA, 1863 bp, Homo sapiens
atgaagatgagagcccagattcccgagtccttgagggaggaagggattgaaattctaaaacctcagttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcgattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 1513 - DNA, 1394 bp, Homo sapiens
gaagagactcccgggctcttaacgtcgggtatcaggagtttcttcccggagcaaggacccccaagacggaagaggatggccgcggcggctctgaggagattttggtcccggcgccgcgcagaggcgggcgacgcggtagtggcgaagccgggagtgtgggcgcggctggggtcctgggcccgcgcgctgctccgggactacgccgaggcctgcagggacgcttcggcggaggctagggcccggccggggcgcgccgctgtgtatgtgggtctgctgggcggcgcggcggcctgcttcacgctggcgcccagcgagggtgccttcgaggaggcgctgctggaggcgtcggggaccctcctgctgctggcgccggccacccgcaaccgcgagtccgaagccttcgtgcagaggctgctctggctgcggggccgtggccgcctgcgctacgtcaacctggggctctgctcgctggtgtacgaggcgcccttcgacgcccaggccagcctctaccaggcgcgttgccgctacctgcagccccgctggaccgacttccccggccgggtcctggacgtgggcttcgtgggtcgctggtgggtgctgggggcctggatgcgcgactgcgacatcaacgacgacgaattcctgcacctgccggcgcatttgcgggtggtcgggccccagcagctgcattccgagaccaacgagcggctcttcgatgagaagtacaagcctgtcgtgctcaccgacgatcaggtggaccaggcgctgtgggaggagcaggtcttgcagaaggagaagaaggacaggctcgccctgagccaggcccactcgctggtgcaggcggaggccccgagatgaaaccctgaggcccccgagtcctggcaaactgcttgcctggggtggtgcagttctgagtgtgcctcacctgcagaacagctgagacagatgatgtgcaaagtgttttctcactggatttgcacaagtttggggagcctttctgccccccgtctttgttctttattagctgaagctaattcagagccacctgggtccgggagttggggacagcagaacgacttgacacatgttcatcactggcagagctggtcatgagccttttatataagcctttttcatcgggcctcagaggccctccttaaggaggtaccacattggtcagctgacttgcaaactcttctaaggccacttagattttctttttcaagtttgggttgtggcctggcatggtgatgtctgtaatcccagcagtttgcaaactgaggcaagagaatcgcttgaggccaggagtttgaggccagctagagtgacatagcaagactccgatgctacaaaaaagaataataatagtaattaactaaataaaatttgagctg

SEQ ID NO: 1514 - DNA, 905 bp, Homo sapiens
ctcacagtcccgcctcttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccctcttgcagtcctgtgttcgggtgagcaggccaggtgagcccacaagtctccatgagtgacgtggcctggcgtgctccaccccaccccaccgcctttagcaaccatgtgcccaggggacagctgggcttctacacctctggccctgagcctgagagccgggaaagagtcttttctccatttaaccccgggtgactcactccctggccagtcctcacccctggggacacaaccagagtcaagctggacatcagtaggtcagatgccacctcacaggaccaaggtgccgattaaaccggaatacattc

SEQ ID NO: 1515 - DNA, 873 bp, Homo sapiens
cagaggtgagtgccacaccctaacctagtctgagtttttatgtgtaaagatcataaaacgttgtaagttttctaaaacacataagctctcaataaacgttagcttatcattgtcaccgttttgttcgtaatgtttgaaaactccaactgtgatccactacactacccttgtgggatgctgtctctttaactctgtgccacgttgtatcccgtgagttcttgcgtttttccgccccgctgtatcccatggttccctgtgccttccggctacgactgctcacagtcccgcctcttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatc

SEQ ID NO: 1516 - DNA, 835 bp, Homo sapiens
gtgtgcgggggccgccattttccgggagtgggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaagggcctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggggccgcctctgtcatctcactag

SEQ ID NO: 1517 - DNA, 2753 bp, Homo sapiens
cccagattctggaactcagctcttaaacctttaaaatctccatccctgagaccgttctccgttggaggatccttccctccccgctttctgaacctctcaacacctcctgtagaccccaaaatgacttctccatgctctcctcccctaaaaccaccaatttctcctccaaaaacccctgtaccccaagccagcagcattccatctcctcctctacccccaagtcccctggacttttcagctttaccatcccctccctggagtcagcagacccctgttcccccaccgctcccactgcctcctccacccgctgccacagggcctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagtggccgatatgggcaggctggcccaggaggtgctgggctgccaggccaagctgctctctggtggcctgggcggtcccaacagagacctcgtcctgcagcacctggtcactggacatcccctgctcatcccctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtgtacgtggtgcccgtgggtggggtacgggctggcctctgtggccaggccctgctcctcacaccacaggactgcagccattagctgcggctgcggtctcaggctgcagcctagctcggtaaccatttgaagtgtgcctacacttctcccactgtgtgatggcgacaagattgaagctaggtctcaggggtctccagtcctccttcatcagggccaccccctgcagtattgagcaccagctggtccctctagggagagattgacaacagcccggaccctgcggcctgcctattccatctgaatgtcgcatcgtctgtttctcactaggggccgcctctgtcatctcactagacatttgaggaacctcctgcctgggccctctgcttctcacaggacagggacactgaactgcgtcagcctcagctcacccctccttagcccaaggtcttcctcatgcttgccacctactagtcatactggccttttagatccctgaagtgttgttcaaatccccggatcattgagtcccacccccagccctctgctgcggatcactccttaacttttccattggggctcaggtatcactacctcagggaagagtcctgcagccccagtcaagacacccctcccccacctcatgtcttcacagttttaaagcccatctgggagcagttacctgtgccagcccctctacctgtgttagcagatctggcaaccctgtaaggggggtgctagatggacccgatttgacagatggcaagactgaggcctggagaagtggaatcactggcctgaggtcacatgactagcacatggcaaggtcaggattcaagctaggtagtcagtatctcagccaggctgtctcctggctccctgaacattatggtgctgaccacaaactttcctgtccacttatacaaacttctagtgagtgtgtgtgattactagcttcatgaatacctgacccctccactctgaaggaggaacaggcctgtctggatcacttctctgtccctaactgagcccatctcatttagggaaactacagagcactgttgctttttttttttttagatggagtctcgttctgtcgtccaggctggagtgcggtggcgtgatctcagctcactccagcctccacttcccaggttcaagtgattctcctgcctcagccccccaagtaactgggattacaggcatgcaccaccatgcctggctaattttttgtatttttagtagagacggggctttgccatgttggccaggctggtctcgaactcctgaccttgagtaatccacccgcctcggcctcccaaagtgctgggattacaggtgtgagccactgagcccggccacagtgcagtatttctaaccagtgatcagggtaaagaggatgcgtgtccaccatcccagccctgatcagcctgtctgtgcatcccccatcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacattggc

SEQ ID NO: 1518 - DNA, 2143 bp, Homo sapiens
aagcgacggagatgcgcgcggggcctgttgggtgaaggagcagagcggccggaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcagaacctccacacatggaactcatccctgctggacctggagacgctgagcctacagagcagagctgccaggctgctcaaacgcagcaaagcctccatctcctcctcctcctccctcagccccagcgatgccagcacttcctcattccccaccagctctgatggcctctctcccttctcggagaccttcatccctgactccagcaagggccttggccccagggcacccgcatccccggcaccagcccaggcccagacccccacccctgctccagccccagcctcctcccaagcaccccttcggccagaggatgacattctgtaccagtggcggcagcggcggaagcttgaacaggctcagggaagcaagggtgacagagcttgggtgccgcctctgacccctgccctccgcacgttggccgagtctctgaaagccaaggccttgccgcccgcagcggggtcagtgatacggaagagcgaagccactccttcccctggagcctgcctgcagcccgaggtcccactctctccagctgagcaggcaaccacagtcaaggcctcgccgccagccttccaggtggggtctccggaggccctggccccgcccccgcccgctgctgaccacgccccctcggaggccctgcttgcccaggccctgctgctgcaggctgcagaagactccgacggcagcgagttccaggacgatcccgtgctgcaggtgctaagagcccatagggcagagctgagtcggcagaaaagggaagcggatgcccgattatcgttcctgttggaccaggctgaagacctgggatcttggtcccctccagccgggtcgccccctaggtccccaaggaggctgctaagaagggaaggagattccctggaggccagaagactttgaattgtacagattctattttacccagtgaggctctttttttttttttcatacagttactggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctag

SEQ ID NO: 1519 - DNA, 772 bp, Homo sapiens
gaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggacagaattagaagatcaggagcagtggctcacacctgtaatcccagcactttgggaggccaaggtgagaggactgcttgaggccaggagttcaagaccagcttgggtgacatggtgagattctgcctctactaaaaaaaaaaaaaaaaa

SEQ ID NO: 1520 - DNA, 2420 bp, Homo sapiens
acctcgcggggcgcgggaaagaggcagagcgcgcgcagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgagccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtagaggc

SEQ ID NO: 1521 - DNA, 2513 bp, Homo sapiens
acctcgcggggcgcgggaaagaggcagagcgcgcgcagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgaggaccttcgtggggatccaggcctctgaggcctccaggatggaggatgccaccaacgtcgtgcgtggcctcatcgttgagctctccaacctgaaccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtagaggc

SEQ ID NO: 1522 - DNA, 879 bp, Homo sapiens
tttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgt

SEQ ID NO: 1523 - DNA, 813 bp, Homo sapiens
tttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggaaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgt

SEQ ID NO: 1524 - DNA, 2123 bp, Homo sapiens
gactgcagaggccgcgccgcctcccccgtccgaggtctgcgcgctccgccgcagggtgcagacccggggcgcccgcctgggtttggggcgcaagagcagaggcggagccagggcggagccagcgcgccgggtcccccctgaatcgaaagcgaaacaggggccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttacc

SEQ ID NO: 1525 - DNA, 2140 bp, Homo sapiens
agaacggtgcctagagatgggggagggatgatcccgtttccccttcccccaccggaacccccctgtctccatcccagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccagacaaagaaactgaggccgaagtcacttgccagcaagcaggggcagctgcgatttgaaccctggccacctggagtcagagcctgggctctaacatgcctgtcagtgggaacccagggggcagggagtggcttgcccaagtccccacagctggaagtgatacagctgggatttgaacccacatctctctcccacttagccgagcacaacgtggcctcaaaggggcgatatgtcacaacatcaacaagcatgtggcatttgcaggcaggaagatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatcctt

SEQ ID NO: 1526 - DNA, 2277 bp, Homo sapiens
ggacgccgctccggggcgggtaggcccccaggatggagcggccggagcccccacccggcacggctgcggggcaggaggagcaggagctgcgggagcgggccttcttctcgtgggccgagttcagccgcttcttcgacgcgtggtgccagcagcggctggcgctcttcttcgtcaagagctccatgcacctggcgcgctgccgctgggccagtgcgcccccgctctacacgctcatcgacgtgctcaagtacagctacgtgcggcttgtgtgcaaggacgtgcgtgcgcccagccggcccgccgtggggcctccccagcccggctgccccgccttcatcatcgtcaagctgagcccgctgcgggaccgcctcgtggtgacggagtgccagctgacccactcacacccggcctgcccgctggagttcgcctactacttccgcccgggccacctgctggccaacgcctgcctgccggtgcgcaccaccaacaagatctccaagcagttcgtggccccagccgacgtgcgccgcctgctgtcctactgcaagggccgcgaccacggcgtcctggacgccctgcacgtgctcgagggcctcttccgcaccgaccccgaggccaaggtgaagctggtgttcgtggaggaccaggctgtggtggagacggtgttcttcctgacgtcgcgcaccagggcgctgctgcggcgcttccctcgcatgctgctggtggaccggctgccggggctgcagggcgcgctggatctgctggccgtgctgtgcgtggacggctcgggccgtgcgcgccaggctgcctgctgcgtggcgcgcccgggcacaccgagcctgctgcgcttcgcgctcgcgtcgctgctgcagagcgcgccagacgtcaagggccgcgtgcgctgcctcaccgccgggcccgaggtggcggcgcagttgcctgcagtgcgccagctgctgccctgcgcgcgcgtgcagatctgccgcgcgcagggcctggagacgctcttcagcaaggcgcaggagctgggcggcgccggccgcgaggacccgggcctgtggtcgcgcctgtgccgcctggctggcgcgtcgtcgcccgcagcctacgacgaggcgctggccgagctccacgcccacggcccagccgccttcgtggactacttcgagcgcaactgggagccccgccgcgacatgtgggtccgcttccgcgccttcgaggcggccagagacctggacgcgtgtgccctggtgcgaggccaccgccggcgactgctgcgtcgtctcagcccctcgcgtggcgtggcgcagtgccttcgcgacctggtggccatgcagtgggccgacgcggccggggaggcggtgcccgaggggcccgatggcggggggccttggctggaggatgagccagggaggggagcccagggggagaacgagagggtgaggggcctggagacaggcgactggggaggggctccgaaagaaggaagtatttggaggggagcccagatggagaaggagtgggcaagggcactggaaaccagagactggggcggggctcagttcgaaggtgagaaggggagggcactgcagatcagagattggagagggggtcggttggagaatcagaagccgaggggactggaagggggtgtcttgagagggtcgaagttagagaaagggcacctgagagggccagagattagagactggagggggccccagttggagggtgagaaagattggggactggaaggttatgtctggagggggtcccagttggaggaccaggcgctaagaggattggaagggtatacctggagggtggcccagctggaagatcgcaggagtaccaccgacctgagggggacccagtttgactatgagaggggaaagggagaaagtacagaagacagatgaaggagaggaggtaagcgagaaaaaatggaaaggggagccggaaatggaggagagaggacaagcaaagagacagaaatgaagacatgaggaaaagctgggggaagcaggagaggaagggacgggatgtaggagggggaagaaaaatcggagatgagacaaaagaaatgtgtgggagacgggtagagacgaaatgcaaggggcgtggttttggtttttctccaagacctggagacatcgacccccatcgccttctgaagagagagggagggcgggcactgggggtcaggagagtctccagcaggggaggggaattgtttggactattgttcttcaggattggaataaaacaatcttattttgg

SEQ ID NO: 1527 - DNA, 946 bp, Homo sapiens
agctcagagacgatggaactgtggaggcagctgaatcaggctggactggtgcctccggggctgggcccacccccccaggccctgagggaggtctccccagtggaaatccctggtcagaccctcaggactgcaggggcagacactggaggtgcctgcgatagtctgctgtggatcagggaggagctggggaacctgcgccgagtggatgtccagctgctgggacagctgtgcagcctggggctggagatgggggcgctgcgggaggaactggtcaccatattggaggaggaggaggagagcagcaaggaagaggaggaggatcaagagccccagaggaagcaggaggaggaacacctggaggcctgcccagccccacatccacctgactttgagatgatgatctgaggctctgccagtggatttagattgacatacaaatgagatgcaaatgtatgtaaaggagaagggagatttgcaggtcaaagcagatgtggaatcaagtatacccctttagtaagtgctttctctgaaggtgcctgcaatgatatttaggcattggcctgtgagctatgggtgtgtttgcagatgacatgaggatgtgtttggaggtgatgtgggaggttgtagagaagttgcaggtgctttcgcagatgagcctcaggtgtgctgctgagatggggatctctgcaaatatgctggtgatgcatacagatgcgatttcagatcaacgctgtccagtatggtagccaccggacacacatggttatttagtgcttgaaacatggggactgcaaattgagatgtgctgtgagtgtaaaatacacaccaaatattaaaggcttagtatgatgaaaagaacataagacatctcaataatttttagattacttattgaaataataatattttgagcatatcagtattagtaaaaatattactaaaatta

SEQ ID NO: 1528 - DNA, 671 bp, Homo sapiens
gcccgggggatccaggcagacatgcaaaccctcaggcaagaggctgcacggccctgtatcccctcggggaccctcgaggccagcttcccagcaccgctgtacagcgatgactacctgtccctggagggttcccgctggccaccagccatcaggcaggccacacgctggaagtacacgcccatgggacgggacgcagccggccagctgtggtacacaggcctgaccaactcggacgcctgggaagcctggtacaacctgccacgggccccggccagccccttccgcgaggcctacaaccgctggcacagctgctaccaacaccgtgagtgcagcatgccatcggcctacacccagcacctgcgggagaccgcctggcatgaccccatcgtccctgcccagtaccaggcccccagcacccggtgggggagcgcgctgtggaaagacaggccaatccggggcaaggaatacgtgctcaacaggaaccggtacggggtggagccactgtggagggcatcagactacgtgccctccctgtcggcaccccagcgcccgcccggcaccacccagaactaccgggagtgggtcctggaaccatactgcccctccacctgccagcggtccccgccttccctcacacccactccccgataaaggcatgctaccaggatgca

SEQ ID NO: 1529 - DNA, 743 bp, Homo sapiens
gatgtcacctggagcgagtagcgcgcggcgtggaacgcgagtcgcgaccccggctcccggcagtggcgcgcactagccctcgcgccgcacgggacacgagggctgggcgggcagcgggatgaggctaaaggttggatttcaaggcgggggctgcttccggaaagacgcgctgtgtttggaaggtggagtgagcgcccggtgggcgagggcacctcattctgcacccctgcgcccgcctcgggaactgcacgcggcacccccacccgcgactcccacgcagacagtagtgcggcctgcagggttcccccggcggacgaggctaatggttcgctccgccccgcccacacagaggccgcccactggctccggctgcgtttcaggactctggaggaagggacttggccttcgccctcagacgctcttaagggtaggcagcgttgtcctcagttctgccccagcactcagacccagactgggtccctgcctccgccctccgccctcggactagtctcttggaagccggcctgtctccgccttcagacctagggagaggtcttaacctctgttctcagactctggaaaaggcttctcaacggcttggcctgacctcagctcctcgcattccctccacatctcaagacaccaacccagggatgcaggacagacacacagacactcagtgagggtcaaatatctttaaataaagtgccaggaacaataaatactgtacaggaagagagtgc

SEQ ID NO: 1530 - DNA, 338 bp, Homo sapiens
ggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttattc

SEQ ID NO: 1531 - DNA, 6200 bp, Homo sapiens
gttaaatctgtggcctttgcatcgaagccatgctttcaagatgtaaaacctatggagctgacaccaggggcccaacagcaaggtataaattatcaagagttgacttcaggatggcaagatgtgaaatcaatgatgttggtaccagagccaactaggaagttcccatcaggaccactgttgactagtgtcagattttcaaatttgtctccagaatcacagcaacaggatgtgaaatctttggagtttactgtagagccaaagttgcaaagcgtaaaacatgtgaaattatcttcagtgtctctgcagcaaactataaaatctgtggaattagcaccagggtcactgcctcaaagagtgaaatatggggagcaaactccaagaacaaattatcaaatcatggaatcctctgaactaatccctagaccagggcatcagtttgcaaaatatgcagagatgatcccacagccaaagtatcaaatccctaaatctgcaaatttgatttcaataccaatttatcacgccacagaatcttcagaaatggcacaaggattggcatataaaggcatagatactgtagagaaatctgtggggttgaccccaaagctaacaggtagagctaaggaatccttagggatgctgctgcagccagatcttcaggtaccaaaatttgttgatctgactccaatggtaagggatcaaggctcaaaattcttaggattaactccagagaaaagctaccaaatcctagaaactatggaattgctctctcagtcacggccccgagttaaggatgtgggggagttatatatgaagccactgcagcaaactgtggaatatgaagggattactccggaactcaagcattactttacagaagctatggggttgaccgctgaggcaaggatacaagcaaatgaattctttggaatgaccccaaagccaacaagtcaagccactggatttgcagagagatccccaaggctctgtcctcaaaacttagaatgtgtggaggtgatctctgagaaaagactgcaaggggaagaatctgtggtattgattccaaagtcattacatcacgtcccagattctgcttcagggatgacacctgggttaggacatcgagttcctgaatctgtggagttgacttctaagtcaggagtgcaggtagagaaaactttgcaattaacccccaaaccacagcatcatgtgggatctccagggataatatcagggttaggacatcaagtcccagaatctgtaaatctgacctgtaagcaatggctacaaatggaggaatctttagaggtgcccctgaagcaaacaagtcaagttataggacatgaagaatctgtagagctcacctctgaggcacggcagcacagggaggtatcaatggggctaacaaagtcaaagaatcaaagtatgaaatctccagggacaaccccaggaccactgggtcgaattgtagaatttatgaggattagtccagagccactagatcaagtcacagaatctgcaaggacacagcttcaagttgctcaatctgaagaggtaatcctcatagatgtcccaaaagttgttcaatctgtgaaagtgacccctggaccaccatttcaaattgtaaagtctgtgacgataccaaggccaacccctcaaatggtagaatatattgagttgactccaaaactgcaatatgtgagaccttcagagcaccacacagggccatgtttgcaagatgtgaaatctacaaaattaatcacaaagccaaaacaccagattttggaaacagtggagttgacagggtttcaaattgtaaaaactatgttaatcccagggccatcccttcaaatcgtaaaatctgaggagttagcaccaggaccaattcctcaggttgtagaaccaataggagtagccctagaatcaggaattgaagcaataaattgtgtggatttacttccaaggccacatcttcaagaactgatagtacctgcagaattaactccaagtccatgtactcaagtgaagtctgcagaattaacctcaccgcaaacatctccatttgaggaacatacaatattgactcataaacaagggcttcaggctgtgaaatctacagtgataaaaacagagcctcctaaagttatggaaactgaggatttgaatctaggacacgtgtgtcagaatagggactgtcagaagttaacatcagaagagttacaagtagggactgacttctctaggttcctacaaagctcttcaaccacactcatttcaagctctgtcagaacagcatctgaattaggaggactttgggattctgggatacaggaagtatccagagctttggatataaaaaaccctgggacagatattttgcagcctgaagagacctatatagaccctactatgatacaatctttaacttttcctttggcccttcataatcaaagctccgataagacagctaacattgtggaaaacccatgtcctgagattctaggagtggatgtaatatctaaagagacaactaagaggaagcaaatggaggagctagagaactcacttcagagacatctaccacaaagctggagatcacgatctaggacattccaggcagaatcaggggttcagaaaggtctcatcaagtctttcccgggcagacaacacaatgtctgggagagtcatgcctggaggcagcgactaccaagaaaatatctctccactatgctaatgctggggaatattttagggaccactatggaaaggaagctttgttctcaaacatctttagcagaaagagccactgcagatacctgtcaatctattcagaatttatttgggattccagctgaactgatggaaccttcccagagcctgccagagaagggtccagttactatttctcagccttctgtggtcaaaaactatattcagagacatactttttatcatggtcataagaaaagaatggccttaaggatatggacacgtggctccacatcttccataatacagcaatactctgggactagagtgagaataaagaagacaaactcaacgttcaatggtatatcccaagaagtcattcaacatatgcctgtctcatgtgcagggggccagcttcctgtcctggtaaagtcagagtcttccctcagcatattttacgatagagaagatcttgttccaatggaagaaagtgaggactcacagagtgattcccagacaaggatttctgagtcccaacactccctcaagccaaattatctttcccaggccaagactgacttctcagaacagttccagttgctagaagatctgcagctaaaaatagcagcaaaactcttaaggagtcaaataccccccgatgtgcctccacctctagcttcaggtctagtcctaaaataccctatctgcctacagtgtggccgatgttcaggacttaattgccatcataaattacagaccacttcggggccttatcttcttatctatccacagctccaccttgtacgcactcctgaaggccatggtgaggttcggttgcatcttggctttaggctgagaattgggaaaagatcccaaatctcaaagtatcgtgaaagagatagacccgtcatacggagaagccctatatcaccatcacaaaggaaagctaaaatctatactcaagcttccaagagtcctacttccacaatagatttgcagtctgggccttcccagtcccctgctcctgtacaagtctacatcaggcgaggacaacgcagcaggcctgacttagtagaaaagacaaaaactagagcacctgggcactatgaattcactcaagttcacaacctaccagagagtgactctgaaagcactcagaatgaaaaacgggctaaagtgagaaccaaaaagacctctgattcaaaatatccaatgaagagaatcaccaagcgacttagaaaacacagaaagttctacacaaacagtagaaccacaatagagagtccttctagggaattagcagcccatttaagaaggaagaggattggagcaactcagacaagtactgcctctttaaaaagacaacctaagaaaccttcccaacccaagttcatgcaactgctttttcagagcctaaagcgggcattccaaacagcacacagagttatagcttctgttgggcggaagcctgtggacgggacaaggccagacaatttgtgggcaagcaaaaactattatccaaaacaaaatgccagggactattgcttaccaagcagtatcaaaagagacaagaggtcagctgacaagctaacgccagcaggctcaaccattaagcaggaggacatattgtggggaggaacggtccagtgcagatcagctcaacagccaagaagagcttactctttccaacccagacctcttcgactgcccaagcccacagattcccaaagtggtattgctttccaaactgcctcagtggggcagcctctgagaactgttcaaaaggacagtagtagcagatcaaagaaaaacttctatagaaatgaaacctccagccaggagtctaagaacttgtccacaccaggaaccagagttcaggcccgaggaagaatcctacctggttcccctgtgaagagaacctggcaccgacatcttaaagacaaactcacacacaaggagcataaccaccccagcttctatagggagagaaccccacgcggtccttctgagagaacccgtcataacccctcttggagaaaccatcgcagtccctctgagagaagccaacgcagttccttggagagaagacatcacagtccctctcagaggagccactgcagtccctctaggaaaaaccattccagtccttctgagagaagctggcgcagtccgtctcagagaaatcactgcagtccccccgagaggagctgtcacagtctctctgaaaggggccttcacagtccctctcagaggagccatcgcggtccctctcagagaagacatcacagtccctcagagagaagccatcgcagtccctcagagagaagccatcgcagttcctctgagagaagacatcgcagtccctcccagaggagccatcgcggtccctcagagagaagccattgcagtccctctgagagaagacatcgcagtccctctcagaggagccatcgtggtccctctgagagaagacatcacagtccctctaagagaagccatcgcagtcccgctcggaggagccatcgcagtccctcagagagaagccatcacagtccctctgagagaagccatcacagtccctctgagagaagacatcacagtccctctgagagaagccattgcagtccctctgagagaagccattgcagtccctctgagagaagacatcgcagtccctctgagagaagacatcacagtccctcagagaaaagccatcacagtccctctgagagaagccatcacagtccctctgagagaagacgtcacagtcccttggagaggagccgtcacagtctcttggagaggagccatcgcagtccctctgagaggagatctcacaggtcctttgagaggagccatcgtaggatttctgagagaagtcacagtccctcagagaagagccacctcagtcccttggaaagaagccgttgcagtccctctgagaggagaggacacagttcctctgggaaaacctgtcacagtccctctgagagaagccatcgcagtccctccgggatgaggcaagggaggacctctgagaggagccatcgcagttcctgtgagagaacccgtcacagtccctctgagatgaggccagggaggccctctgggaggaaccattgcagtccctctgagaggagccgacgcagtccccttaaggagggactcaagtacagtttccctggagagaggcccagccatagtttgtctagagatttcaagaatcaaacaactctcctcgggaccacacataaaaatcccaaagcagggcaagtgtggaggcctgaagctactcgatgaggcgaggtccgcccctattattcattgtcctaagtcttcatcgtgctgccctttccaggcttctttcctgctcagccactgcctccaattcctgcgcccccagcgtggaaaggcttccatttctctctaccgggggggaggcgggtgagaatgggtctgtaatttctctaagatgaataaaggggcagtaaatg

SEQ ID NO: 1532 - DNA, 1331 bp, Homo sapiens
cctcccatgttaacactattgtttctttctgtttactttcagttggttggcagagaatttgaactggagatgaactttattatccaggatgctgagagtataacatgcatgacagagcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcagagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctgctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaa

SEQ ID NO: 1533 - DNA, 1325 bp, Homo sapiens
gtcacctgggctgggagggcggcttaggggcggaagcggcggtccagggccgcctggtgcagcagcctgtctcagccgcggtccctccagtccctccctggcggctgcggagccgtccgaggacaggggccataaactctccagagcgggaagccgcacgctggtggcccggccccgcgcacagacctggcggcagctggcacctgacccgctgcatgggtctccagggagctcgctgcccacccggcgctgcagcctcggctccctcgtacgcgctctggtggagatgactgtgtgtgcgcacacctgggggtgaagaggacgcagcctgtctacctgacccatgaaatggaggagactgtaccccagaagcagcgggttcactgctccattgattaagcaagtctgggacacacatgtagctaagctgtgacttctgtgccagcggtcccaacacccacgccttcaggaagacacatgtgtgaggggttgcatgtttgtcaggcctgagagtggagagcaggggccagagacactagctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaacttc

SEQ ID NO: 1534 - DNA, 2581 bp, Homo sapiens
acttgccgcgcgtgggcggctctgaccaataacgattgtcgttacagcgaacagtttggccccgtttgtaaaaggccgcggcaggcgaagagagaagagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcactagtttttcctaattata

SEQ ID NO: 1535 - DNA, 551 bp, Homo sapiens
aaaaggccgcggcaggcgaagagagaagagacccatcccggaagccggccgggaggtgagcgtcccggagtcgggcggccgctccgttgactgcagggccccggcggtcttcctccgctgttccgaggccgttgagggctgatgtgctccatcctcccacttgtggtttggcaagccatccagccgactacaaacccacgtttactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattga

SEQ ID NO: 1536 - DNA, 576 bp, Homo sapiens
gtaaaaggccgcggcaggcgaagagagaagaggtgagggcggtcgtcagctaagggccccggggctcgcggggggtgcgcagggcagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatg

SEQ ID NO: 1537 - DNA, 536 bp, Homo sapiens
actatcaagatctccacttagggaagtgggaatcttatttgcggaacattgggcagaagctttgccattggctggtggagaaggaggaggcagaatgtctgcattgttacaccatacagctcaaacttcagaagattttggggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgt

SEQ ID NO: 1538 - DNA, 2193 bp, Homo sapiens
cctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcac

SEQ ID NO: 1539 - DNA, 578 bp, Homo sapiens
agcaaggaccggggcggcggtggggcaggggtgtagagctcgggttcccagcggaaagcatgtccaaggagcggctgccggcgaggtgatgcttctgcctgggcctacttgggaccggaaactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcct

SEQ ID NO: 1540 - DNA, 548 bp, Homo sapiens
gtaaaaggccgcggcaggcgaagagagaagaggtgagggcggtcgtcagctaagggccccggggctcgcggggggtgcgcagggcagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagt

SEQ ID NO: 1541 - DNA, 662 bp, Homo sapiens
aagaggtgagggcggtcgtcagctaagggccccggggctcgcggggggtgcgcagggcaggtaagggggtagtgctgagcaaggaccggggcggcggtggggcaggggtgtagagctcgggttcccagcggaaagcatgtccaaggagcggctgccggcgaggtgatgcttctgcctgggcctacttgggaccggaagtgagcgctcgcgcggggaggatgccgggaagcaggtcccaggggatatgtgtgtgtcgctgcagacccatcccggaagccggccgggagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtg

SEQ ID NO: 1542 - DNA, 563 bp, Homo sapiens
tttggccccgtttgtaaaaggccgcggcaggcgaagagagaagagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccat

SEQ ID NO: 1543 - DNA, 1133 bp, Homo sapiens
ggccgggaggtgagcgtcccggagtcgggcggccgctccgttgactgcagggccccggcggtcttcctccgctgttccgaggccgttgagggctgatgtgctccatcctcccacttgtggtttggcaagccatccagccgactacaaacccacgtttgtgagttacctgctggctgtgacgcttccgtcaaatctgagtaacagtttcctcatctctaagatgggtaacatagtatctacctcacaggatcgtgtgggcagtacatgcatagaaaggatttaacacgcagtgtactcagctagttttattatttatccgtaatgatcatttgttcttttcccctaactgtgcctcacaagcatgaaacagaatccaccaaacatttaggtctgggtagtggttggatggaaacccatcgcgggttaacgcttccaacaccagtcccttgacactctcccgccgaggaggctgatttgtaaacttgctgagaagagaatacccagcagatctttcagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctct

SEQ ID NO: 1544 - DNA, 2903 bp, Homo sapiens
acctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagca

SEQ ID NO: 1545 - DNA, 1179 bp, Homo sapiens
acttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctgattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatg

SEQ ID NO: 1546 - DNA, 933 bp, Homo sapiens
ctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttata

SEQ ID NO: 1547 - DNA, 973 bp, Homo sapiens
gtgccgccttcccaggaccctcagggagagcgggcagccttccaggtggacaggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattag

SEQ ID NO: 1548 - DNA, 3817 bp, Homo sapiens
acagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggttattgtggc

SEQ ID NO: 1549 - DNA, 562 bp, Homo sapiens
aacccactgaccagggagcgtggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggca

SEQ ID NO: 1550 - DNA, 3700 bp, Homo sapiens
gggcggccacagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggtta

SEQ ID NO: 1551 - DNA, 1897 bp, Homo sapiens
agctacgctcactgacacgcatctcatgctgtgctaggatgttgtccccatgttagtgtgccctctccagggagactgccagccctcgtgggtgtgcatcttctgcttctgcatccttggtcactgccagcagaggtctgggcacatggtggtggacagtggctattaactgtggttgtgctggaatggaggaggcctggtgtctggtcttggagtcaagaatgcatgtgcttaaggattccaagatcacacggaggagggtgctgggagaccgtgaagtgcaaagcagatggagtccaggccctcggggagacagcacgccagtgagggagatggagaccaatcacccacccagtgtgcggggatgagaagctcgggaaggtctgaccagccttacgtcttgaaagggaatcccctgcttctgcgtgtcaggtgttactcggggtgcgccagtggaagcgggaggcagttgcagctttcagtcttccaggatctcaaccagttctctcactgcagagtctggagaagcccagccctcattgtgaagggagagccaccgtggtgctcacagcaagacacccagagtcccttccagacagggacacccctggagcgaccctgtttcagaatgaagttatctgggtgggaactcaccaagaatgcacagagggcgctgggctccaagcttcagcatatcctttcactggactccacacaggcctgcggagcaggtggacccaccattctcagaccccccagggccccatagacagcagatctgctgctttcaatcacacccactgcctctcatgccggagtgggggaaatggaacccgcaaagcctgcaggccagggagggtgggaaactggggtgatgtgagcccacagggtggagcactgtggactgaatgcctgtgtcccctgggttcatatgttgaacccctaactcccaatgtgatggtgtcaggaggtggagcctttgggaggtggttaggccgtgagggtggagacccatgctggggttggtgcccttatggttctcccatgtgaggacacagagggcagccatctacaagccaagaagagaggcctcaccagacaccaaacctgccggcaccttgctgtgagatttccagcccccagagctgtgagaaataaatttctgttgtttaaggcactcaatattttgttacagtagcccaagctgactgagcagatattcatatggaaagtgaattttgatctctacttcatgccgtacataaaagccaattccagattgactgtagatacagattggcaaagcaaaacagtacagtttctagaaagaaacaggaaaatatctgcatgaggtggtcaaatatttcctagagaggacacaaaaagcactaactacaaaataaacaatgataaattggactgcattaaaattaagaacatctgtttaacaaaagaccccacgaagagcgtgagaagccagagtgcagagtgggaggagaaatctgacctgagatgggaaattagaatatgaagaactccttcaagtcagcaagaagacaggcaagccgagaggaggacgggcaaacgacctcaacagacactttacagaagagatatccaggccaggtgcagtggctcatgcctgtaatcccagcactttgggaggctgaggccggtggatcacctgggatcaggagtccaagatcagcctggccaacatgtcgaagtgccatctctactaaaaatacaaaaatttgctgggcttggtggtgtgcacttgtaatcccagctacatgggaagcggaggtgggagaatttcttgaacccgggaggcagactttgcagtgagctgagatcgtgccactgcactccagcctgcgggacagagtgagactcc

SEQ ID NO: 1552 - DNA, 4768 bp, Homo sapiens
gacacgccatttgtttctacgtctgacatcctcctcttttctctggtccgtgggagcttttgcaagcgggaccaggccccaacacccgaaccagcagcgagagaaggagcccggcatgcggcgactcagagtgacgacacacgcgagtctccgcccgagtacgtcacttccgcaacgcttccttcgcggggctttgtgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacgctaaacagaaccatgacttaacgcataggaaaagtccttcaggccctgtgaagtcgccaccattgtcccctgttggaactactccagtgaagttaaagagagctgctcctaaagaagaggcagaggccatgaataacctgaagcccccacaagcaaaaaggaagatacaacatgttacttggccctgaagaaaagtttccaaaaatgtaaatatactgtaactgtagtttttcaaatatgttcatatatattgacaatatttacagaaatcctgattattgtggaattttcttaagaggtttcaaataggtttaaaaaaataaaggatttattttccttcccttcttccctccctcccttccttttttaaaattcttgcctgtcttgccctgattaggaaagaatatctttttaaaccaatggcttagtatatgtcatttatattgaccctactgaaattattagctacaaatgtgctataaagcatccattgaattggccaggcgcagtggctcacgcctataatcccagcactttgagagactgaggtgggcagatcacctgaggtcaggagtttgagaccagcctgaccaacatggagaaaccccgtctctactaaaaaatacaaaattagctgggcatagtggtgcatgcctgtaatcccagctattcaggaggctgagacaggagaatcgcttgaacctgagaggcggaggttgcggggagccaagatcgcaccattgcactccagcctgggcaacaagagcgaaactccatctcaaaaaaaaaaaagcattcagtgaattttcggagttactctcattagccttgttcagagtctttgggggaaatttgagatttttgagattttttttaaaaactcaaatattttactagtttgcctgccattttatttcttttacaaagcagaagcatataccaatttatcacagtattttagtaaatactgcaacattcatccttaaatgttcaccaagaaaagcatctttgtagtagtgctggaaaactattcagaatatacagataaaaatgctgttctttaattgcttacattgcttcttcccataaaaagcaaaaaggaatcagtgcttgctattgctcctttccttgaagttgtaacaattgatacatatattatgagttgactggtcgattctgtacctggcccatcctttagaatgttcttgtcatgtagcagtcctacgtactcttttcatgagcagtctgtgatctcactctgtgagttcagctattactcgctcgtgggagcttaatcttttcaaaatgaagttgatttaaaaagtcttcaggcagagtaatcatgttagaggtggtattcgatggaagaaagtttagagagttaggagtgggggtagaattctagaatttataagagtccaggaagcatagcagtcaggggcaaaaattagcgtaatatggagtaggcaatagaggagctactggagtcagaagtcactgcagagtgcaacataggaagatggactcctagcttacatgagattccctgcagctgtaatatagacaattcccacatggctgttctacacagaattacctgctaagattttttgtttatttttgtttgagtggtattttcactccaattgtataatggaaatcagtgggaaaatagggtttaccttatattcatgagttctagtttctactgttctgctatgtgtttctaagcaagagcaaaggatacttcatacttttttcgttatatgattgatcttcaaattgggatttacctttttcaatatgttttaaagtagtcttattcctcttttgatttgttaaacaagcattttagttcagctattgaatagccttccaaaaaattaattcagccttgcaggtaagtaccatactaagactttaacccaatagtttttaatcattctgcctttattccaaactgtaaatctgtacacataagataaaacatactaagtattgcataaattgttaacgttacagtaaattgttatctgcagggctgacagacataatgttggtgggcaactgtgatcctatacatacatatatgcaaaaggggattttaaaagtgcagattatagagtagattgacaaattttattttatattcagttgtcctctctgcttccatctgtgttgctctcttagttgagagagagttagccatttgacgattttaagtcagtgggaacttatttttagttactcaataaaattaatattttatttgtattttaacttacagagtaggttggtaataacagctgaactgtgtaacattgttgcttcaaattgaagtttatattatgaacattcagaatcaatgctcatgtagcagcatattattgagctattttgagtttgaaatgtggagaaacgctaaaccatgtactatgtgttaacataatcccaccttcttagagctttgttccttctgaaggtgtatagatacagcttgtcttgaaatgtctttctccacataatgaagcatgctgaatgctgggaatctggagcagcagccctgggagccctgagttttgaagtgttttggtttgcttcaaaggttagaagaacttgatatgtatggcaaacaactttagaatactagttactcactaacatgaggcgggtaatgttgctctagattctatattccagtaaagccagcttttcttattattggagtaggcaaatgaatggcattagaattagtgggtggcttgtaagttgtagttataggcactttaccacttcctgccattagcaggcatccttgttttttcttttccctctttgttccttcttttccctttctccttatacattttctttctctactttaattctccttcctccttactgtagatcccaagcttctagcttaggtttgcaagtcatattgcttggccctccacattcactgagaggtgaagataggctgaccccctgtcctcttacatttgagggatcatagactgctgtgtgaattctggaaagtctcaggtccctaccagggcactgaatggcttctcaatggctgtagagacagtacagttttccaaagcagcctaattcatctggacagctaccaggcactttggaaagttggttcagttactactatgaggccataatatatttgctggtattaaaattcttcagaattggaattactatttgaaataatattttggttgacttaagttttgagagacaattctaaaattgatctagagactcattcaatagcaatgtgaccttttaaatacttacattaagtaaaactgccagtagattaaatcatatatatatatatatatatatatatatatgtaagagcttcctctatttactactgttgaacttcagtaatttttagaggctaaataatggtcagaatgtttttaagtgtgctcttttattacatgcttgtgcaggttttgtaattcagtacagaaaagtttaaccttgtacatttttgtatgtaaaaagtcttttaagtagtcttatccttatttaaataaacagaataaaattaccttgagtaggtctgttattcttattaaaatggaaaaatgctctgtaatgacttgatctgtttttatttgagtgaacaattttggaaagtattctttatagtacaactttctatacctggattgattaagatcagatgtgattcgagtagtccagccatatcttgtagcccttctttgaatgagagggtggctggagtggtctggtgctgggatatcacggtgctacagagcctgacatgttgactgtcactacatgttgagggatggaaatagaagtctctgaacttcccatgtaatattaaagctcttaacaaaatgagacaaactagagattcagttgagagattttatgttagagtgatctgaaaaaaagttaatttctaaactgctatcttaatattattatatttggagactgatgctgtaaattaaataacttggaaaaga

SEQ ID NO: 1553 - DNA, 1027 bp, Homo sapiens
gacacgccatttgtttctacgtctgacatcctcctcttttctctggtccgtgggagcttttgcaagcgggaccaggccccaacacccgaaccagcagcgagagaaggagcccggcatgcggcgactcagagtgacgacacacgcgagtctccgcccgagtacgtcacttccgcaacgcttccttcgcggggctttgtgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcagaaccatgacttaacgcataggaaaagtccttcaggccctgtgaagtcgccaccattgtcccctgttggaactactccagtgaagttaaagagagctgctcctaaagaagaggcagaggccatgaataacctgaagcccccacaagcaaaaaggaagatacaacatgttacttggccctgaagaaaagtttccaaaaatgtaaatatactgtaactgtagtttttcaaatatgttcatatatattgacaatatttacagaaatcctgattattgtggaattttcttaagaggtttcaaataggtttaaaaaaataaaggatttattttccttcccttcttccctccctcccttccttttttaaaattcttgcctgtcttgccctgattaggaaagaatatcttttt

SEQ ID NO: 1554 - DNA, 2684 bp, Homo sapiens
cctttcctaggagctgtccgttcccaggacaacagtcaacacagcacaggcgggagttcaaaacgaaactgggctcaaatgctctccccagcccggagagccctgtccccatcggccactctgagctcgaggcctaaagggacagtgaggaggaccctgcccaggctctcccggggttaggagggacagagtgttccaggaggaggtttgagctgagctcaggcacaggtctctctctctctctctctgacacaagcgcacacacacacacacacttgcaccatggggagccaccccacccctgggctccagagaaccacatcagctgggtaccgattgccccccaccaggccaccagcctcggtctccccagctgcccggggtggccctatggccagcaggggtcttgctggtggctgccaggccccccaggctctgaaggcgcagcgggtggctcagggagctgcctgcgatggcgtgcagcaggaccagctgtggcgggagctcctggaggccgagcggcggggccagcagcgctggattcagaactggagtttcctgaaagactatgacccaatgggcaacaagaaggagcctgagaagttgccagaccatgtgcctctcttttcggacacagttcccagttccacgaaccaggttgtgggcagcaggctggacacacccctgggacagactctcatccgcatggacttcttcttcacagaaggggcccggaagaagaagctggaggaccagatgcagcccatctaggagcaaggagggctgggctggccttccccaggtgggtgtgggtggggacaagagacccagcccacaacagcaccagtcagctccccacacaaggcagcttgggtctgcactgtctgtaagctgcaggacactcttccaggggacccaaggggtcactcttacacactttttacacgtaagattcagaggagtcagtaactggtccacggccgtacaatccccagcccttccagcttgggaactcatgggtgccccatgaaagggaccctgcattgtggtcaggagcactgaatgcctgggttcaaatccagcttgtgaccctgatgagctgtgggaccttgagctggctgctgcaacactctgtgcctccgtctcccctcctgcgattcagtgtgttcactccttgcagctgctgtgacaagtgagcacaaactgcatagcttaaaacaacacaaacgtatcatcttacagctctgaagatcacaactctgacatgggtgacatgttgcagagctgtgctcttttaggagtatctggggaagaatctatttccacattttttccagtttctcaaggcagcctgtattccttagttggcagctccttactccgtctttgaagccagcatcctagcatcttcaaatcagtctctatcgcttgctctctcctgcctcactccttcatcttttctttctttctctctctctctcttttttttttagagacagtgtcttactctgtcacctaggctagagggcagtgatgcaattataaatcattgtagccttgaactcccgggctcaagcaatcctcccacctcagcctcccaagtagctagggatacagacacatggcaacatgcctggctaattttttttttatttttattccagacagagtctcgcactgtcgcctaggctggagtgcaacagtgtgatcttggctcaccgcaacctccgcctcctaggtccaggcaattctcctgcttctgcctcctgagtagctggaattacaggcatgtgccgccatgcctggctaattttttgtatttttagtagagatggggtttctccatgttggtcaggctggtctgaaactcccaacttcaggtgatccgcctgcctcagcctcccaaagtgctgggattacaggtgtgagccactgcgcccggccatgcctggctaatttttaaaattttatgtagagatagggtctcactatgttgaccaggctggtcttgaacttttgggctcaaatgatcctcccaccttggcctcccaaagcactgggattacaggcatctggtttcacttcctccaccttttaaggacccttgtgattatatcacaacctttatatttaagcaaaaaaatgcagaaaaggcttagttcctctttgttggttaaaacacaaatggattcattctttcaaacatccgcattctcctcttcttcctgggtgctctgccaggctgtggtttcccttggtttgggtggagcatgtgacagagccatggccagtggaatgggagcaaaaaccctaggtctcccttccaggcctggtccatgagacactccaggtattggcttgttctcctttccccatcagctgaagaagggagaggacttggaggatgcagggaagagaggggcacaagatggagggagcatgtcaggaccaagcctggagccctgagtgagctcgtggagcagaatctcccgacacccacactgacacacaaacaaaataaacaaaaactggccaaaacaaaaacaatagcccacacttctagggtaaagcattttaaatttattttctcaacaacccaagagaatcaacaggcagggatttcgtattcatttaatacaggcaaaacctgagattcagagaggtgaaataaaatcccgaacata

SEQ ID NO: 1555 - DNA, 980 bp, Homo sapiens
aaatgctctccccagcccggagagccctgtccccatcggccactctgagctcgaggcctaaagggacagtgaggaggaccctgcccaggctctcccggggttaggagggacagagtgttccaggaggaggtttgagctgagctcaggcacaggtctctctctctctctctctgacacaagcgcacacacacacacacacttgcaccatggggagccaccccacccctgggctccagagaaccacatcagctgggtaccgattgccccccaccaggccaccagcctcggtctccccagctgcccggggtggccctatggccagcaggggtcttgctggtggctgccaggccccccaggctctgaaggcgcagcgggtggctcagggagctgcctgcgatggcgtgcagcaggaccagctgtggcgggagctcctggaggccgagcggcggggccagcagcgctggattcagaactggagtttcctgaaagactatgacccaatgggcaacaagaaggagcctgagaagttgccagaccatgtgcctctcttttcggacacagttcccagttccacgaaccaggttgtgggcagcaggctggacacacccctgggacagactctcatccgcatggacttcttcttcacagaaggggcccggaagaagaagctggaggaccagatgcagcccatctaggagcaaggagggctgggctggccttccccaggagttacacaggacaggacacgttatttccatgcaacagcccctgtgtttcatgccataccctggccctgagcgactgtgtgatggagcagaccaggcccagtgtgacttggccaggaagaggcccaacccttcctacttggatctggaggccaccgccttctttctcagtgtctgacatggaagctgggctccctctccactctgagatcatcagctgggtaaaggtcagtggccaggacagccaggggtcct

SEQ ID NO: 1556 - DNA, 2001 bp, Homo sapiens
agctcccattggggtcggcgaacctggtgccaccccttagacaaagtcccagtctcccagaggcttttaccagctggccccattccttctgctgctgggtataataaggtcctctcaacgctgaagtgcctgtgaaacacagcccagaggagttctcattggtcctatgggctttgtcttcctctctgccccacccagataatcgctgctgcccctccactcccaagatgcagctgtgattctccatccccacacatccctcatcaatggttgactgcaaagaagtgagaagccaagcttagattcatgctcatgcctgaacaccctgagagcctggtgctggagggctgggtatccccttggcctgccaccagcacctgcacccacaccaggctggagccacgctctgcgcacagaaggtggccttgatttctcaggcacagctgacctcagagatactggtcctgactctgccaggtctcttatccctagtcttgttgccccagttccttctggattcaaggcgatgttgcctcaaaacaaggaccaggtgctgccacagacctcagtgctccctgggcgccccacttggggcttctcacaacttgtggactcctctcctcacaacctacagcctctctctccccatcagggcctccctccctctcaaccaccgttctcttccactcagtcccgtcgtccctcctcccctccaccagcatccccctctcctggcttccaattcggctcttgtgactcaaattctgactttgctccacatccctattctccctctctcccaagttcccctactttctttcaccagaactacctctctctcccccgtccacgtgcatcctctccctccaaccactggctgtacccctctccccctctgaccccttccttttctccctcccagcctcagaactcctcccttccccactcaccttgccagtccccttcccaccccgaggaactgcatagctccacactcacttccccaggccccagcccaccttctcataggctccactctaacaggcagacatggcgctggcatcagtacagggacactgggtccgggtcccctggagtggtggagagatgcgtgccaagcgagaaggatcctgcacagttcagggacccaggggccctggcccaggccctggtggtccagctggggcaccgccgcatcgcacacgacctgcggctactgcttttgcagcacctgtggctaggcagaaccggccaggccccagtcgtggagtatcctatatgcctggtgtgcctccggccccgcagcccctcctgccccctccccaggtacaggactggaccccggctgcttgctttccctcaactactgccctgtgtgcagggccaggaatctgggccactccggataggcatcggcttcggcctccgcctgcctcagggccaggccagggccttgcatctgctgcccgagaaaaggccgaaggaagcagggcctcagggcaaggctactcaggcctgtgggcatcaattgccagcatctcagcctccagcagctcaggcccgggccgacccagtcccaggcacaccctcccagaccaggagcttcaggtctgcaggccttcaatcaccaaactccccacgatgtttctccgggcctccacctcgggcaccaaaacaggtcactacctccctgaagcccaggccttgccctggcccaaagaggccagtttctctggagctcattctccaaaagtcatcagtctagttccagagccacggaggccccctggaacaccccctccaaacccaaccctcccaaccaggccccagatctcggggagtccccgagacaccctgaagggctggctggccggaggtcaggtgtgttctcctgctctgaaccctgggagccccttgtggagtctgctgtctccaggctgaagaggaccaagggcaccaaggccccattcagccctccgtgtatctaataaagtctgaccc

SEQ ID NO: 1557 - DNA, 2017 bp, Homo sapiens
atcactggtgctgcaagtcgctgagctgacagttgtgccgaggactgtcaccattgggcaggcatggtggccagctcctcacttggctgaggtccagggatggacacaggtgtctggggttggggagctgcagcctgcaggtgggggccagcagagagggctgcaggttcgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaaggatcctcagccaaggggtggacctggtgccggccagcgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcctggcgcccgaggactgggcagaactgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgacgaaatgctgtatatttggttttgaaaaaatgaatgtgctgggtatacacagcagaaagggtactgtccactttttgtatatcagtgtggaaaatatttcccctagaagtagaaaaggctcatgtgctgatggataattttgagtcttctccattctctgtgaatgacccccttccccaggcatccccacctcctacctcgttcttagagcaaactaaagccaactgagggtgcacacacagccatgagcccacctgcccaggactactcccatctgcttcttcccgtccccgtggaagtggcccctgatatggattgtatctgtatccccacccaaatctcaggtagaattggatctgtgtccccacccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccggccatgtaagatatgcctccttctccttcaccttccaccatgattgtcagtttcctgaggcctcccagccatgcttcctgtatagcctgcgggactgtgagtcaattaaacctctttattcatt

SEQ ID NO: 1558 - DNA, 1911 bp, Homo sapiens
actgtgctgtcactctggaattctgctgtgtgggagctgaggccccacctgcagacctgctgctcacctgggcaggtgcctcctcacagcccatctgcacagctggcctgcggagtcctcctcaggggccactggccctcacctgccactgttgaagggatgcctgcccctgctctccccacctcagccatggccgtgcaggtgcccctgtggcaccactacctgcaggccatccggtcccgggaggcgccgcgtgcccaggacttccagcgcgcagagaacgtgctgctcacggtgctggagcgcgtgcatgccctggacccccgcttcatcgtggactactcccgtggcctggaggccttccagttcgccctgcgctcctctgaggacccaatggacatggaggtgcccctgtgggtggatgccgaggctctactgattgaggaaccagaggccacccagccggaggatggccttgaattatgccacctgggtgtgcccagggaaggggctggcctggagcggtggaccaccgaggataccttcactgcctcctcggagggtgacgccaagtgccgtggacacattgtgcccagcaaggtcctgtgtgtcctcaaggacctgctggtagcagccatcgtacactgcaagcaccacagtctcatcgcaccaggttcgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaaggatcctcagccaaggggtggacctggtgccggccagcgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcctggcgcccgaggactgggcagaactgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgacgaaatgctgtatatttggttttgaaaaaatgaatgtgctgggtatacacagcagaaaggg

SEQ ID NO: 1559 - DNA, 1958 bp, Homo sapiens
actggtgctgcaagtcgctgagctgacagttgtgccgaggactgtcaccattgggcaggcatggtggccagctcctcacttggctgaggtccagggatggacacaggttcgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaaggatcctcagccaaggggtggacctggtgccggccagcgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcctggcgcccgaggactgggcagaactgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgacgaaatgctgtatatttggttttgaaaaaatgaatgtgctgggtatacacagcagaaagggtactgtccactttttgtatatcagtgtggaaaatatttcccctagaagtagaaaaggctcatgtgctgatggataattttgagtcttctccattctctgtgaatgacccccttccccaggcatccccacctcctacctcgttcttagagcaaactaaagccaactgagggtgcacacacagccatgagcccacctgcccaggactactcccatctgcttcttcccgtccccgtggaagtggcccctgatatggattgtatctgtatccccacccaaatctcaggtagaattggatctgtgtccccacccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccggccatgtaagatatgcctccttctccttcaccttccaccatgattgtcagtttcctgaggcctcccagccatgcttcctgtatagcctgcgggactgtgagtcaattaaacctctttattcatta

SEQ ID NO: 1560 - DNA, 549 bp, Homo sapiens
gcgagtttctccacctgggtgaggtggagccacggagactgcttttctccagaaccagacgagctccagctcccaggctagcccatctgcacagctggcctgcggagtcctcctcaggggccactggccctcacctgccactgttgaagggatgcctgcccctgctctccccacctcagccatggccgtgcaggtgcccctgtggcaccactacctgcaggccatccggtcccgggaggcgccgcgtgcccaggacttccagcgcgcagagaacgtgctgctcacggtgctggagcgcgtgcatgccctggacccccgcttcatcgtggactactcccgtggcctggaggccttccagttcgccctgcgctcctctgaggacccaatggacatggaggtgcccctgtgggtggatgccgaggctctactgattgaggaaccagaggccacccagccggaggatggccttgaattatgccacctgggtgtgcccagggaaggggctggcctggagcggtggaccaccgaggataccttcactgcctcctc

SEQ ID NO: 1561 - DNA, 3907 bp, Homo sapiens
aggggagctgagcggcgtccgcccccgccgagccgagcggagccgagcgaagccggcgcgcctgcagctgggagctgggagctgggagcgcgccgggcgcagggccgggccggccgcgggagggtagtgtcagcgcccgcgtccagctcttcggccgcagacccgggctgtctggaggccgcgcggccacctgctgcgtcgccccggctttgggctggggctagacgcgcaccgcggcgggagcagccccggctcgccgcaccccgcggaaggtgcccttctctgcgcgtctcgccgagcccgggccacgctcctgtcccagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggaggagtcgaggggcacgctgggcagccgggccctttctcacgacagtattttcattcctgagtccggacaggacgctactcggcctgtgcgggtgttttcccaagaaaatgtgtgtgatcggattaaagctctgcagttaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtcctggtaccaccataaaggtctctgtcgtgtctccagaccacgtgagcgacagcaccgtctctgcccggatctcagacaacagcctggcaccagtggctgacttcagttatcctgcagaatcctcctcctgcctggacaactctgcagctaagcacaagctccaggtcaagccccgcaaccagcggtcgagtaagatgaggcggctctcatcgcgcgctcagtctgaatccctgagcgacctgacgtgcaccccagaggaggaggaaaacgaggagaagccacttttggaagtcagcccagaagagcgccccagctctgggcagcaggacgtggcgccagacagaggccctgagcctgggccaccggcgcccttgccgccacccggaggggcccgtgccagacgcgcccgcctgcagcactcctccgcgctcacggccagcgtggaggaggggggcgtccccggggaggacccctcaagccgcccggccaccccggagctcgccgagcccgagtcggcccccactctccgcgtggagcccccgtccccgccggagggccccccgaatcccggtcccgacggcggaaagcaggatggggaggcgccccccgcaggcccgtgtgccccggccacggacaaggcggaggaggtggtctgtgctcccgaagacgtcgcgagcccgtttcccaccgccatccctgagggggacacgactccccccgagactgaccccgccgccacctcagaggcgccctctgctcgcgacgggccagaacgcagtgtcccgaaggaagcggagccgacgccgcccgtgctcccggatgaggagaaggggcccccagggccggcgcctgagcccgagagagaagcggagacggagcccgagagaggagcggggaccgagcccgagagaattgggaccgagccctccacggcgcccgccccgagcccgccggcgcccaagagctgcctgaaacaccggcccgcggccgccagcgagggccccgccgcgtccccgccgcttgccgctgcggagtctcccccggtggagcccggccccggttccctcgacgcagaggccgccgccccggagcgccccaaggccgagcgagccgaggcgccaccggcgggcgccgagagggcggcgccagagcggaaggcggagaggggcggtgccgagctgcgaggcgcgaagaagttctcggtgtcctcgtgccgagcgcggcctcgtccgggcgtctcccgcccgctggaacgggccagcggccgcctgcccctcgcgaggagcggcccggtctggaggagcgaggcggctcttgacgacctccagggtctccccgagccccagcacgcgaaacctggccctcggaagctggcggagcgcggccctcaggactcgggggacagggcggccagcccggccgggccgcgcaagagccctcaggaggcggccgccgcgcccggcacgagagagccctgcccagccgcccaggagccggccccgagtgaggacagaaaccccttccccgtcaagctccggtccacctccctctcgctcaaatacagggatggcgcctctcaggaggtgaagggtgtgaagaggtacagtgccgaggtccggttagaaaggtcgctgaccgtgctcccgaaggaggagaagtgtcccctcgggacggcccccgcccttcgaggcaccagggcccccagcgaccaaggaaaggggaaggcccggccccccgagccgctcagctccaagccgcccctgccccggaagccgcttctgcagagcttcacgctcccgcaccagcccgcgccccccgacgccggcccgggagagcgggaacccaggaaggagcccaggacggcggagaaaaggccgctgcgcaggggagctgaaaagagtctgccgcctgcagcaacagggcctggagctgatgggcagcctgcgccaccctggatcaccgtcactcggcagaagcggagggggaccttggaccagccacccaaccaggaagacaagcctggggcacggaccctgaagtctgaaccaggaaagcaagccaaggtgcccgagagaggccaggagcctgtgaagcaagctgactttgttcgcagcaagtctttcctgataacccctgtgaagcccgctgtggaccggaagcagggggcaaagctcaacttcaaggaggggctgcaaagaggaatctcattgtcccatcagaacttggctcagtctgcagtgatgatggagaaggaactgcatcagctgaagagagccagttatgccagtacagatcagccatcctggatggaacttgccagaaagaaatctcaagcttggagtgacatgccccagattataaaataggtgggcagtgtgctgataaagcatgtccactaccctgacaagccacttagttaaaaactgccagtgtattgtggcaaacaaactgtgaaacttaaagattgattttatcatcaagttatgacgaacttggggaagaggaaggaaccaggcaaaacaaagaggataaacacacagccatactcctgggccagagggcccagaaacaagaacaacattgaaaaagtccaggaaccagttcctgtgcccaaaggtacgaatgtgtcttttcgaattcccttgataaagaagcctcagacaaggaagaaaatagaaatgaaattggacacataaataggacacccagcaaaggccagaagagaagcccttctaggagaagggacatctgtgcttccagctgagatcagcccatgtctctggtcgctctcttgcctgtggatcctgtcttctttcatgtttactacgaggcatgacattcatggcaaaacagggatgccgtttccaagagcagctataaaacaatctgttttcctaaagacagccactctgagaaggagatgaaggaacacggcagggttcatcaattcatagactgtttccaaaaataatttttaaacttttccactaggcatctgtgtctttaaccactgcacaatgcattgcctgtttaataaaaggtttcaaacatg

SEQ ID NO: 1562 - DNA, 1420 bp, Homo sapiens
actccctccaaccgccacaagcagcaaagggcatagatgaccacaggagagccctagggggaggccggctccaccagcagccccatacatggcactcccagggtaccccctgggcaacgtggatgacagcaggtctaaggacagcccagcaggagagccccaaggtcaggtcccactcacagcagatgtcttggcagtgagcagctctgtcgcatccactgactggcaggatatagatcaggcctccttcaagacggccacccccagggccatatcaacatctggagacaaagacaagagtgcagttgttccagaacacggccagaagacacccagaaaaatcacacctctgcttcccagccaaaatccaagtcccctgcaagtgtctatgagccttcagaatccagcgtgggacaggcaggttcaagacgcaaggacaagtcagagtctagtggttttcccaagtcacctcctgggtaaagacaagatgtcacaaatggcgagtgttcctgagagagagccggagtcagccccctctgccccgagtgctgagctacagtccacccagcacatggaggctcagcccgtcgagagtgatgctgaccatgtcacagcaggtgccaatggccagcatggccctcaggctgccagcaccaccaagtctgctgaggagaaagctgagcatccaaaggccccacaccctgaagctgaagctttaccatctgatgagtccccagtggcaatgggggcaaatgtggtggacagcttaggagacctgcagacttggttcttccctccacctccagcaggcagtgtgtccccgtcgcctggcccccacgaggtggccctggggagaaggcccctggactccagcctgtacacggccagtgaggagaacagctacatgcgctccatgaccagcctgctggacaggggcgagggctccatcagctccctggcagacatcctggtgtggtccgagaccaccatgggcatggccatagccacaggcttcctggattccggccacagcactgtggcagacctgctgcacagctcggggcccagcttgcgctcggtccccagcctggtgggaagcgtcagctcggccttctcctctgggctggtgtcagggaccagctcagccctgcgcaccatcacccgtgtgctggagacagtggagcagaggaccgtggagggcatccgctcagccatgcgctacctgaccagccacctcaccccacgccaggcccaggctgaccccaactatgattagagccctgcacagggacccccgaagggctggttcagtggcctccagagatccctgggaccctcacgccctgctcccttgcccattcttgctctggacggttcccccagcccatgcaataaatcaccagtgagcatttatttctaa

SEQ ID NO: 1563 - DNA, 1621 bp, Homo sapiens
gagctcaggttcagcctagagagagaggaggccaccatggaccagccagccgtcgccaccgcttccacctcaataagggaagacctggtgggtggagaatcattcatcacagcttcgaaaccagcccaaaagacttcctcttttgaaagagaaggatggtggagaatagcattaacagatactcctatacctggcacttaccacttgaaaacttttattgaagaatccctattaaatccagtgatagcaacctacaattttaaaaacgaaggaaggaaaaagccacctcttgtgcaaagaaacaatccagtcctaaatgatcttccgcagtatatgcctcctgacttcctggacctgttaaagaagcaagtggctacttactcattcaaagacaaaccacggccaagccccagcacactagttgacaaagatcagtcacttcagctttctccggggcaatacaacgtgcttcctgcaccagttcccaaatatgcttccaggagctgtgtatttcgctcaacagttcaaagattcccaacaacctattttattcccgtaagtataatgtagacagttaactcatgatgaatttgatgtttaaaatacgctgtgctttctggagtggagcaaggtggccacatagaaccctccagtgatcgttccccctagcaggaacaccattatccacacaattatccacacaagaaaacacctctgtaagaaccaaaaagcaagtgtgggatcgcaataccaggttttaacattgtatcaaggaaagaggcactgaagagggtagggtagaaaagacagtcttgaattactgacactaccctcccccatcccctggcagcagccacgtggcatgaagagagaatctgcccttggggaagagggaatgccgtgacggggggactttgcacgggaacaccgtgctgcctgtaacagggaaagcaacacaggacagaattcagctagtgcccatggagggagcatttagaccagcactagccagccaggaattgcccatcccagccgttcgatactgagttccagctctccctaccactgtgggctgaagtgctctgaggtcctaaataagcttgaaaggcagtctcggccacaaggactgcagttcctgggcaagttcaggtgctctgctgggctcagaggcagtggacttagggtacacaagacctagtgagacaccagctggggcagccaaaggagtgcttgtagcagccatcccccagccccaggcagcacagcttgcagcttcaagagagaggccttccttttgcttgagaggaggagaggggagagtaaagaggacttgtcttgaatctggataccagctcagccacagcagaatagggcacctcaggcagagtcctgaggcccccataccaggccctagctcccagacaacatttctagacacatctctggctggaagagaatccactgccttaaagagaaggacccagttctggcaagattcatcacctactgactaaagagcccttgggcttcgaataaacaccagcagtggccagacaacactcactgcaggccttagccagtgctgtgctgcttcaggtgtgatccagcactttcccagcta

SEQ ID NO: 1564 - DNA, 891 bp, Homo sapiens
agcactaaagacaaacctggcgggtcccccggagcggtcccaggcgcgcgcgctcgggagcccacgggccacacccgcctcctagcaaccggagctcaggttcagcctagagagagaggaggccaccatggaccagccagccgtcgccaccgcttccacctcaataagggaagacctggtgggtggagaatcattcatcacagcttcgaaaccagcccaaaagacttcctcttttgaaagagaaggatggtggagaatagcattaacagatactcctatacctggcacttaccacttgaaaacttttattgaagaatccctattaaatccagtgatagcaacctacaattttaaaaacgaaggaaggaaaaagccacctcttgtgcaaagaaacaatccagtcctaaatgatcttccgcagtatatgcctcctgacttcctggacctgttaaagaagcaagtggctacttactcattcaaagacaaaccacggccaagccccagcacactagttgacaaagatcagtcacttcagctttctccggggcaatacaacgtgcttcctgcaccagttcccaaatatgcttccaggagctgtgtatttcgctcaacagttcaaagattcccaacaacctattttattccccatgaaggccctggtccaggtcattataatgtgaaaatgcctccaacaagctctgtcacttcttgttttcaatccagagtccctcgattcttgcccagctgttcaaaaaccccaggcccaggagcatatacaactttaagacaattccctaagcagtctccgaccatagccaaaatgggccaagagcatagccttttcttcaacaacaacaattggcttttaaaataaagtgatcttggcaccaa

SEQ ID NO: 1565 - DNA, 1323 bp, Homo sapiens
cacagaccgggtagaggcaggcccacagcatgtcctccaaggtttactccacaggctccagagctaaggaccaccagccctcgggtccggagtgtctgccactcccagaggccaatgctgaagccatcgacttcctcagctccctccacaaggaggagctacagatgctgttcttctctgagacgctggccatggtctcagacaccggggagcctcagggagagctgaccattgaggtgcagagagggaaataccaggaaaaactcggcatgctgacatactgcctcttcgtgcatgcctctagccgaggcttcttggacaaaatgctctgcggaaattccctcctgggctatctctcagagaagctggagctcatggaacagcacagccaagacttcatcaagttcctcatcctccccatggaacggaagatgagtttgctgaagcaggatgatcagctggctgtgaccagaagtatcaaggagggtgaggaagtgaagactggagtgacttctttcccctggagctcaatcaagggcttcatctcagaggctgccaacctggtgctgctcagggtgatggcctggcggcggatggtgcccagcaatgcccgcttcctgaccttggacaccgagggcaaactctgctatttgacctatcaaaacctgggcttccagaccatccaggtagaccatcagcaggctgaagtcttcatcgtggagcagactgtccacgcggaggagggcatccccatgtcctgccagtactacctgctctccgatgggcacctggccaagagaatacaggtgggctccccagggtgctgcatcatcaccaagatgcccatcttgagggaagaggatgagattgagccacgcccagtgtttgagaagaagcccctggtatgggaggaggatatggagctctattcgaagttcctggaccggaaggaggagctccggctcggccacgccagctatctgcggcagcaccccgaagcccacgcgctcatctccgacttcctgctcttcctgctgctgcgccagccggaggacgtggtcaccttcgccgccgagttcttcggccccttcgacccgtggcgtccgtcgtcaccggccttgggctcctcccaccggcccaaccctttccgctccctggagccggagggagacgcccgctcgggggcggcctaagcggggcccaggcccggacagggcaggaaaccaggggtcgggctgggacgcgggcgggacgcgccggggcgggtgcgctttccgggctgcggttttgggggaataaatggggccctcccgcttctctgca

SEQ ID NO: 1566 - DNA, 2248 bp, Homo sapiens
aagatgcagttccacctcccagattccctagttactatctctaagcactgaagtcggtgtttggagaaaaggactcaggtgaggactggagcctaacagatgagacagaatataaacaggaagtctctaaggcagtgtggtggaaggataataccatgatggaggaagtgcacagtattatgggagaacatagcagtggcatctgaccaattttaagggaatccaggacagctttcctgaagctgaagaaagagtaaaagccaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataaggtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggtttaatgagttaatctcacttggtgaatatgaaaaggcagcttgttatgcagcaaacagtcctagaagaattcttcgaaacattggtacaatgaatacatttaaggctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatga

SEQ ID NO: 1567 - DNA, 430 bp, Homo sapiens
gaggaccatccactgggtgtcgggggagcttctgccccaagtagcaggagggagctgtcaaggcgtggagttcacactcaaacactcccagaggacggcactctgcatgggacgccatccagctcctttgactgtggaatcaagtacattatcagctggcccctggctcctggctgtgacctcccttcgcttgaactgagccttgtgtgcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctga

SEQ ID NO: 1568 - DNA, 2052 bp, Homo sapiens
tctaagcactgaagtcggtgtttggagaaaaggactcaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataagctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatgacatttagatttgtctttgaaatatttatactattgcttccttttccccatatggtcatttcttatattgaatcttgataaaatccaagattataactttgtgtgaaacagtgtagggcatttttatctaaggacataagctaatgtccagatatattactttctggtgatgtaatatgatagcaagaactgaggaaggtgtgggtagtatcctgtgtgttagactgtcttcccaaacatgaaatgctacaagcctgacttgaccagaaaagcaggaaatcatttcaaggttggacttgctggcaaaaacctagagtatagtaattttgtactgctgatttaaagatgcgccccatgctttgatatatataaatatggcaaagcttaggcttctagtataaaagctgggactcttggcatgttattacttagagagaagaccagtcgaattttgcatagaagtagacctgtgatacctataggtatggaaaatatgtcataagaagtggttttggattatttcaagtgtctgaataagtatttgattgaaaactctgaaagttctgtgccatggacaggtgtaatattaaaaatatttaatgattagtatggcatgggcacaaatcaagcagaacagatacctaattaatcagaacagcctttagcccttatgccacaccagagcttactagctaaatgtcatccttgaccatggaacatggttaaaatgagctgctggctgggcaaggtagctcatgtctgtaatcccagcactttgggaggtcgaggcaggaggatcgcttgagcccaggagtttgagaccagctaggtaacacagtgagatcccgtctctgttatt

SEQ ID NO: 1569 - DNA, 2139 bp, Homo sapiens
gttaagcggggggcaaagggtgcggggcacgaaaggtgtccttcactcacttccagaagcggtgatgggcagagaatcagcaatctaccagacgctccttgggccttcaagggaagggaatttgcgtggcctgctccaggcaaactgaaaaataggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataaggtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggtttaatgagttaatctcacttggtgaatatgaaaaggcagcttgttatgcagcaaacagtcctagaagaattcttcgaaacattggtacaatgaatacatttaaggctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatga

SEQ ID NO: 1570 - DNA, 499 bp, Homo sapiens
aagtagcaggagggagctgtcaaggcgtggagttcacactcaaacactcccagaggacggcactctgcatgggacgccatccagctcctttgactgtggaatcaagtacattatcagctggcccctggctcctggctgtgacctcccttcgcttgaactgagccttgtgtgtaagggcgtatcaagttgtatgggcttcgccgctgggtgaccccaaatgcaactccaggaagcatgggttaccaatgactttaaggttaacgatcagctgggcgcggtggctgacgcctgtaatcccagcactttgggaggtcgaggcgaatggatcacgaggtcaggagttcaagaccagcctggccaacatggcttatcaaagttttggctttgttgcaagagcaggtcaagatttagctgttcttcagtgaacaagtgtgcagattgtcaaatatgtcagttcatcaaataagaaaacatgcagttctcccacctatcatttgta

SEQ ID NO: 1571 - DNA, 616 bp, Homo sapiens
tagttctccactgctttcttctaccttggactacttgtcccaagatgcagttccacctcccagattccctagttactatctctaagcactgaagtcggtgtttggagaaaaggactcagcctaacagatgagacagaatataaacaggaagtctctaaggcagtgtggtggaaggataataccatgatggaggaagtgcacagtattatgggagaacatagcagtggcatctgaccaattttaagggaatccaggacagctttcctgaagctgaagaaagagtaaaagccaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataaggtaatagagcatatcactgcatacaaatccattcttacttcaatcaaaaaagaatatgatgcctt

SEQ ID NO: 1572 - DNA, 2837 bp, Homo sapiens
gttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgagatgtctctgcccacccacgcaacccagactatgaagagtccggtgaaagcagcagtagtggaggctctgagctggagccttctggccatcagctcttctgcttagaatacgaggcagacagtggagaggtcacatcagttatcgtctatcagggtgatgacccaggaaaggtgagtgagaaggtgtcggcacacacgcctctggatccacccatgcgagaagccctcaagttgcgtatccaggaggagattgcaaagcgccagagccaacactgaccatgttgaaggcgttctctccaggctggattcactgcactcggaagaattctgcccagggaatttagtgtgggggtaccaggaccagtttgtctgatcttgagacccccagagctgctgcatccatagggtgttgcaggactacacctggcctgccttgcagtcattctttcttatatgttgacccatttgcccagcctgatattctggaattcttttttttttttttttttttttttttttgaggattttgtgtggctaatgtgttctagaagcagagactccagggagaaccagaatttatgaagcctcgtgcaacatggtgctttctcaccgaggtcatatgcctggctgctgctgttccactcagctccatgagccacgtttgttattttatgtttcttctgtgcttttgctcatttccacccatgtgtttatagaccttttttcagccctttttctttgttcctttccctcatctttttgcctcaggtagaatccatcagttttcctccccctccaaatgactgtgtacctccagctgctcaggactttggaggtgggggcggggcctggggatctacccttctaaaaaactctccaagtaattctgataccaataaagtgggagacctccatttttgaggcctatttgcaagcatgtctccctccctttccatggctttttcgtttctcgcatgttccactgctttgcactgtctagacaggaaacctaggaagatgttggtgctaaactgaaaagatttcttacagcaaaacctgcctcggccagggctacagaattccaactttcaacttgattcctagccgtgaacagactgtcctctgctcagactaaaagggaattataaacaagtgggaacttactctccagttgtgacttaacagttctgaacatacctacaaagggaaagtcaatattagcaataattgcctgattgacagcacgccagagggaatgaaatgaggccttctctcctacctcccaggagtatgtaactcagatccttagcataaagatccccaggaataccactgctctaacccggtgaacattttttctaatgcagggttaggcttacgtctgaattccacaagacatcctccccctccagtacggaagttccaaggcacttgttttccagcatatcagcctaacctcagtgccttgaaatatggctttaagcctttgagaactgagatttcctgaaaccataggcccttgccccaggggtttctccacatccgggtgttaagacacctgatggcactgttggtttgtcccctataccccagaaaatctatcctgcaaggtagctacttcaatcttgtcattaaaatgtgtcaagtcacagctcgcaatgccaaaggaatgctggggcagtaagtgaggtggataagtgagaagggcctggtggtgaaagcggccagggaccagaatgctccagacctacagagctggtcaaggttaagtgccttaaacttaccaatcctgggctcagttctcctttgaaaggagaaagtctttgtcctctacttaggcagctgggctagaagtgccttttgacttctaatgttaactaccctccaaagcctcctgggtcaagaaggctctcccaaactccacccctgttcttcctggtcagagaaccagtcagtcattctagtcttctagtccttaaactgatctgatgacttggaacataggatttcactgcaagtctggctttttagtctggaaatacatttgaggtctgttttcgcacagctggatcacctgtttcctggttttattacacaattcagaaggctagaagaggagtttgggggcttggcacctgaaaatttagaccgcattcttattaagtaaaggaagaggtagggaggccgaggcgggcggatcatgaaatcaggagatccagaccgtcctggctaacacagaaaccccgtctctactaaaaatacaaaaaattagctgggcatggtgacatgtgcctgtagtccatcccagctactcgggaggccgaggcaagagaatcacctaaacctggaaggcggaggttgcagtgagccgagatcacaccactgcacttcaggctgggcagcagagcgagactccatctcaaaaaaaaaaaaaaaaggaagaggtaaaaggcaaggcagcatttaataagtacctgttgtatccttttaagtgtttgttgtggtaatcctcacaaagaccgggactgatggaaactccttgctattaaactttttttcttgaggaa

SEQ ID NO: 1573 - DNA, 1722 bp, Homo sapiens
gttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgaggtgaggccgcccgccccgcctgcctccagcccgcgcgctcttcctgcaacgcactccccttctctatagggaaaaaccacttcttactcctaaggttcagctcatctcgtctctttccggaacctccacctcagcgctcccaaatctccgctgaatgattctcaccaagaactgggacgactcataagcccccagttaagcatcgctgtcagagtatcggggagccagcaagaagtttatctgccggtttgccccaccgtgctgtattttagtaaggtgctccgctacctagcaaagagaaagtctggcacagcgatgagcgaccagcacataattgcggaatgaacccagtaaatggcctttccccagcttctctgctacctagagatcacactggttaatatatgacggtcaatttttgttaagcattattactttttttaaaatgtttttattttatttttgagactaggtctctgtcgcccaggctggagtgcaatggtgcgatctgggcttactgcagccttagcctcccgagtacctgggaccacaggcgtgtgccaccacaccggttaattttggtatttcttgtagagaaggggtttccccggctgggcgcggtggctctcgcctgtaatcccagcactttgggaggccgaggcgggcggatcacgaggtcaggagatcgagaccatcctggctaacatggtgaaacccccgtctctactaaaaatacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcaacacagcaagactcggtctcaaaaaaaaaaaaaaaagagagagagagaaggggtttctccacgttgtccaggctgatctcgaactcctgagctcaggtgatctgcccgcatcggcctcccaaagtgctgggattataggtgtgtgccactacctttgttaggcattagtgaaagtgcttttagatcttacgtatattaattcattgagtctttatacaacctcataagaaagcttctgtctgtttcacagtcaggaaacaggcacagagaggttaaacaacttgcccaagatctcagctagtaaatggcagagcctggatttgaacccaggcagagctctatccacccttctgctttccagtactttttgctagacaaatgtgcattgtgtacctactgtgtgacaggattgtgctggcctcagagcagggatgcaaaggtaaataagtccttgattggcagcacaccaaatgcttacactggtccgggcgcggtgattcatgcctgtgatcctagcagtttgggaggccgaggtgggcggatcccttgaggccaggagttcgaaattaacctggac

SEQ ID NO: 1574 - DNA, 731 bp, Homo sapiens
gcgccaggctcgctgtactcgcgcacccaccatggcctcccgcagcgcgggcaccctactgaccgagttcaatgccgcctacgtgccccctggactcatgcccgggtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatgaccatgcta

SEQ ID NO: 1575 - DNA, 860 bp, Homo sapiens
gcgcagtcagatccgaggacatgttgacgtcgtccgagagtcttaaaatcctgctctggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtacaaat

SEQ ID NO: 1576 - DNA, 887 bp, Homo sapiens
atgagtcttctagctaaacctatgagctttgaaaccacagcaatcactttcttcatcatccttctaatttgcctcatttgcatcctcctcttattggtggtttttttatataaatgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtacaaat

SEQ ID NO: 1577 - DNA, 676 bp, Homo sapiens
gcaaacgccgggagtagccgaaggggacgccgggaacaggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcatacctgtattaagctctttattccactgctgaatttttgaaattgacaaacaaatcttaaaaaattaatcccaggctatactctttgagctaaaatctggttatttctttctcttcaggtctttccttctctctttctttttctttgttgttgtaaaataatatattatgagaaaaacatttgatctttttaaagggaaataaattgttattaaaaa

SEQ ID NO: 1578 - DNA, 1150 bp, Homo sapiens
tcgagagttgggttcagtcctggcccgttgtggggacggcacgcgggggaaggggaggggacggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttgggccagctgaggggcccacggacatagggcacccacaataggcgtgtgtctgctgtgtgtttgtgttcggccgtcctgcttctctgtttccacacgtacacatgcccctgtgttactttggttcatcttctgtactctgtcagttttctgctggtcagaacatctgtgactgtgacagagctgtccaggattgcagtggataggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcatacctgtattaagctctttattccactgctgaatttttgaaattgacaaacaaatcttaaaaaattaatcccaggctatactctttgagctaaaatctggttatttctttctcttcaggtctttccttctctctttctttttctttgttgttgtaaaataatatattatgagaaaaacatttgatctttttaaagggaaataaattgttattaaaaatta

SEQ ID NO: 1579 - DNA, 747 bp, Homo sapiens
acggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttggcacgttctttgacttgcttgtggccgtagtgtcaggcctgtattgcacatttatgtctgtggtgcatttctccatctggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcat

SEQ ID NO: 1580 - DNA, 950 bp, Homo sapiens
acggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttggcacgttctttgacttgcttgtggccgtagtgtcaggcctgtattgcacatttatgtctgtggtgcatttctccatctgggccagctgaggggcccacggacatagggcacccacaataggcgtgtgtctgctgtgtgtttgtgttcggccgtcctgcttctctgtttccacacgtacacatgcccctgtgttactttggttcatcttctgtactctgtcagttttctgctggtcagaacatctgtgactgtgacagagctgtccaggattgcagtggataggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcat

SEQ ID NO: 1581 - DNA, 2181 bp, Homo sapiens
acttccggcggcgttgccaagcaaccgcgtggtacgagtaacaactccaccggctggcgtccgcggcgcttggcgccacagtcacttttccagatctaggagcatcatggacacctcgtcagagatgctggtacggtttggacggcgctgtggacgggcgaaggaaagtacagaaataagaaactctgaagaagatcaagttctctatctgcctcttctacctagcaaagtagatctccagcaggtcaccataattccacacgatgagtggaaaaggattcaagatagccttgacaggttgacaagagaagcagcatgcctccgtgcagaaagaaaggcaaagaaagaaatgcatttgcgatctcaagaagtggtaaaacactggactaatacatatgcagggatgaaagaacagaaacttgaagccaaaaagaagcgtgatgaagaaatagaggcagaaagacaaattcttgatctggaagaagaaatatacaaacaaggaaaaagaaaaaaggccattgaaaatgcaaagcaatatcaattttaccagacagaaagagtgaaaaactttcattcgggacttcttcttagtagagttatgaaagaacgtgatgcccagattgaattccgaaagagtaagataaaatcagataaaaaatgggaggaacagttgaaactcaacattgaaaaagcttttaaagaagaacaagaaaaagcagaaaaacgacacagagaaagggtggctcttgccaaagatcatctaaaacaaataaaggaacatgaggaagaagaggaaagaaggaaaaaatatgaagaaaaagatgctgaggaaataaagcgacagaatgcattatatgaaattgaaatgagaaaaaaactagaaaagaaaagagaagagatgcatgaaagcaggagacggtttcttgaacatatgcaggataaacatattatcaaagctgtagaacagcagcagcaagaggaagaagatgaaaagatgagaaaattcatcaaagcaaaaaagcgtcttatacaaatggggaaagaaaaagaggctgaaacacacaggcttatggagaaacgaagagaaagaatacataacttcctgagtgaactgttgaaagagaaacttgacaatgaagatatgattattgctagagatattgcagaagctgaggctgaatgggaaaaaagagaaagagaaaaagatgaaaaaaacaaagcagaattaaaaacaattgcagaatatcgagccattgtgatgaaaaataaagaggaagaagaaagacaaagaaaaatagaggctaaagaacaattgctggctgtcatgaaagcagatcagattttctgggaacatgaaaaggagaaaaaatgcaaagctgataaagaacatcaagaggttcaagatgcccatattcagcaaatggccaaaaataagtttaatgcaaagcaagcaaaacaagcagaattagattattgcagacttactgaagctcttgtggctgaaaaggagaaagaatttcaggactatgccagagaggtaattgaacttgaatcggaaacaacaaataaatatatttaccctcttgtaaaagctgtacaggaaggacctggaggtggccgtggaccagtgtttgtggacagaggtggattaagacccagctatcaggcaaatgatgttactggagtccagctccctttttataactctcagggaccaaaatataattttcaaaagtcaaagagaaggctaggttttacatggtagaaaaaaattatttttaacattgagaagactaagttgtagcatatatgagcttcaaatataaatggatttcagttaataaagctgttcttcatctaagtacaattatgtctgatttaattgattgttctcagtatttcttttgggtatatataaaaccccaattttgagattcctttttttaactgtggtaaaatacacaagtttactttttaaatgtacattcagtggtattaagtacattcaaaatattgtgtagccatgaccattgtgtagttccagaatttttcagtgctcttactagaaaccccatacccattcattaagcagtcactccccattccccttccccacagctcctggtaactttatctgctttgcctatactgggtattttgaataaacagaatcatactgtg

SEQ ID NO: 1582 - DNA, 2745 bp, Homo sapiens
aaatttgtatcatcacaaggggccagtgaccagtaaccagtgaccagtggccttcatactggacacatgcactggttggcttcagccacccagacatccgctagtatcgtctcttcttcccttctatctgcagttgatgtttcttcttctctgaccatgtcagaatatttccaaaatacgtctttacctggaactgcaaattctcggcagttctctcttcctgtggtgagcaatgcagctttcttaacaggaagcatctccaacttctccagagcctctgctccagccatcagctcagcatggctacagccatcagcctctggcacctccttccagccactcatgggcagtgcctacctttaccaacattctagcacaactatgttgtctggggttactggccagagccatatctgtacttcagctgcctcttatccaggcgtttttgagtgggatagtacagcaagcacagtaaagaagtcatcctcactcagggacttcactgtgactgtcattgatcagaacacagctgtctcttccatgtctatgacagcccagtattataaaacttcagataccaatactatggtccctctgtatccatcactatctgccagccttgttcaggggacactaactcaaattccaaatcagcagggccataacctgtcacttccctgccagataggaagccaggtctattactataatcaaggcacactggggcctcaactatcctgcctgcaatcttatggctctgtgtcatacacaggatatagggcttctgcccatcaaccagaaatggtgatggtgctgaaggaggttcagcccacaaatgtcctaccaccagtctctacttctgggatgtattactctgtgtcttctcaacccatcacagaaaccagtgttcaagtgatggaaacttccctggggatggatacttccctgggattgcaatctccaagccagacattttgtctgccacaaactccagaattctccaagtccttcagtagcagaaatacccagacacttgagagtaacccatcacctgagcttggggacatttcaataactccagtccagagtcctactaatctcttgacactgtctccagctccaagccaggaaaaaaatgagaatgagaatttggatgagattaaaaccaacctttcaagaaatcaagatcctccactacttcctgtagaaatccccgatattcacccgcttctggcctgcattgatcctcttggccaagaggagcagcctggttctgaaaatgccaatctaagaaataagagcctgagtcttgaggaccaagggatatttgaaaatgggattgagtctagcagtgatttggcagacatcactacatgggtggaggatacttacctccccccgatcttcagttccttacaagatcttgaccaacctgaaaagtcatgtgtcataaagggtcactctgatcaagtcaggaagaacaagcataaagcttccgagcctatccagggtgctcccaaggccaaaatccagccaaagaacccagagtgcctattagagagagaagtggttgttggcagtgctacagtcagtaacagcgcttctgtgaacaaggccaagcattctagcaacaaacctcacaaggctgcatccagcaggatcagcaaaactaagagccatgggcaggaaaagaccaaagggaacagaaagaacagctccaagaaatctgaagagagtaagcagtcagggaaaaaagtcaaggtagaagagaagcaaaccattcccaatatgaaacggaagaaaaatcaacctgagcttagccaaaagacccttaaaaagccccgaagctccctaggcatgcacatgctagagtccgtgcaagttttccatgcactcgggaaaaagatcgatatgaaaactggattctcttcctccaggaccctgggaagctcaagcaacacccaaaaccgccagccattcccagctctcaaaccatggctggatatccaacatgagggtaaaggcccggagaaaattcaagtcaaggcccagaaactagatggtagtgctgaaaaagagtgtacatctccatcccactctgagttgccaccacctgggaaggtcaagttgatacctttgccctttctgaccctggaccaacctcaagctcgacatgtttctcggcggccaaaccctctagcctcacgtaggcctgctgtggcttaccctgctcgacctgattctactaactcagctcaatcgaatgcagtcaatccatcccgaccagctcctaccaacacatctttgacaggtcctgccacaccagctcagccaatttcagccaaagcaacccaacccagttcagccaaccctacccagcctactgtccctcaatctgctgcttctaggccatcagcctacaaaacatcatcttgttcttctctgcagcgggagcctgtttccactgctgtgaccagtctccggtcactgcccaagcctcaaaatcaatttctaatccaagacttcagcctccaaccccgtccatggaggaaacccactgttcctgagccagtaatgtcaacgcccatcacagaagagcagaggccagagcgtgaggccatgaagagaaaggctcaacaagagcgtgagaatgctgccaaatacacctctttggggaaagtgcagtttttcattgaaagggaaagagatatggaaattgctgaatactatggctacacaatctaa

SEQ ID NO: 1583 - DNA, 3045 bp, Homo sapiens
ccaccaaaccgaccaccacctggtagcatcttggggtttcctgggcgtggcctgtaaatttgtatcatcacaaggggccagtgaccagtaaccagtgaccagtggccttcatactggacacatgcactggttggcttcagccacccagacatccgctagtatcgtctcttcttcccttctatctgcagttgatgtttcttcttctctgaccatgtcagaatatttccaaaatacgtctttacctggaactgcaaattctcggcagttctctcttcctgtggtgagcaatgcagctttcttaacaggaagcatctccaacttctccagagcctctgctccagccatcagctcagcatggctacagccatcagcctctggcacctccttccagccactcatgggcagtgcctacctttaccaacattctagcacaactatgttgtctggggttactggccagagccatatctgtacttcagctgcctcttatccaggcgtttttgagtgggatagtacagcaagcacagtaaagaagtcatcctcactcagggacttcactgtgactgtcattgatcagaacacagctgtctcttccatgtctatgacagcccagtattataaaacttcagataccaatactatggtccctctgtatccatcactatctgccagccttgttcaggggacactaactcaaattccaaatcagcagggccataacctgtcacttccctgccagataggaagccaggtctattactataatcaaggcacactggggcctcaactatcctgcctgcaatcttatggctctgtgtcatacacaggatatagggcttctgcccatcaaccagaaatggtgatggtgctgaaggaggttcagcccacaaatgtcctaccaccagtctctacttctgggatgtattactctgtgtcttctcaacccatcacagaaaccagtgttcaagtgatggaaacttccctggggatggatacttccctgggattgcaatctccaagccagacattttgtctgccacaaactccagaattctccaagtccttcagtagcagaaatacccagacacttgagagtaacccatcacctgagcttggggacatttcaataactccagtccagagtcctactaatctcttgacactgtctccagctccaagccaggaaaaaaatgagaatgagaatttggatgagattaaaaccaacctttcaaagcctctagatgtccaccagatcctaataggaaatcaagatcctccactacttcctgtagaaatccccgatattcacccgcttctggcctgcattgatcctcttggccaagaggagcagcctggttctgaaaatgccaatctaagaaataagagcctgagtcttgaggaccaagggatatttgaaaatgggattgagtctagcagtgatttggcagacatcactacatgggtggaggatacttacctccccccgatcttcagttccttacaagatcttgaccaacctgaaagtccctcagcaaagaaagccaaagataccagtgccatcaaggtaaatcaggtgcaggaaaagtcatgtgtcataaagggtcactctgatcaagtcaggaagaacaagcataaagcttccgagcctatccagggtgctcccaaggccaaaatccagccaaagaacccagagtgcctattagagagagaagtggttgttggcagtgctacagtcagtaacagcgcttctgtgaacaaggccaagcattctagcaacaaacctcacaaggctgcatccagcaggatcagcaaaactaagagccatgggcaggaaaagaccaaagggaacagaaagaacagctccaagaaatctgaagagagtaagcagtcagggaaaaaagtcaaggtagaagagaagcaaaccattcccaatatgaaacggaagaaaaatcaacctgagcttagccaaaagacccttaaaaagccccgaagctccctaggcatgcacatgctagagtccgtgcaagttttccatgcactcgggaaaaagatcgatatgaaaactggattctcttcctccaggaccctgggaagctcaagcaacacccaaaaccgccagccattcccagctctcaaaccatggctggatatccaacatgagggtaaaggcccggagaaaattcaagtcaaggcccagaaactagatggtagtgctgaaaaagagtgtacatctccatcccactctgagttgccaccacctgggaaggtcaagttgatacctttgccctttctgaccctggaccaacctcaagctcgacatgtttctcggcggccaaaccctctagcctcacgtaggcctgctgtggcttaccctgctcgacctgattctactaactcagctcaatcgaatgcagtcaatccatcccgaccagctcctaccaacacatctttgacaggtcctgccacaccagctcagccaatttcagccaaagcaacccaacccagttcagccaaccctacccagcctactgtccctcaatctgctgcttctaggccatcagcctacaaaacatcatcttgttcttctctgcagcgggagcctgtttccactgctgtgaccagtctccggtcactgcccaagcctcaaaatcaatttctaatccaagacttcagcctccaaccccgtccatggaggaaacccactgttcctgagccagtaatgtcaacgcccatcacagaagagcagaggccagagcgtgaggccatgaagagaaaggctcaacaagagcgtgagaatgctgccaaatacacctctttggggaaagtgcagtttttcattgaaagggaaagagatatggaaattgctgaatactatggctacacaatctaagagctgagattgttggttttactttggataccgctggttttccacatatatagatagatactaatttatttattctgatatatttttaaaacataataaagaaatgtaatagaattgattaatagataagtaataaagaggccttttgagttttg

SEQ ID NO: 1584 - DNA, 1238 bp, Homo sapiens
agcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaa

SEQ ID NO: 1585 - DNA, 386 bp, Homo sapiens
aagaacaaaagcactggaaccggtctccggttggtgagcgattctcaaaggggaatttgttaagagcaggcacttaatagaacagcccgagagacctgtaccacgattgcagcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtggg

SEQ ID NO: 1586 - DNA, 2227 bp, Homo sapiens
gagggttcccctggtcttaaaaggggcccaagcccccattctggcacaccccactccactgtcctggcagcagcaggtgtggccaatggaggggggtgctggcccccaggattcccccagccaaactgtctttgtcaccacgtgaggctcacacctttcatccttccccaccttccctagtccctgcactaggttggacagcccccattggctacaggaaagcgggaggggtgtgagtcccctactccctctttgcagtggccccagcccccttaccgtctgcctgggatctgagtacatattgcagtgatggagatgcagtcacctattgtccagaggcaggagaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgactcagcagtgcattccattcaccatcagccaggcccgggaggccatgctgcagatcaccgagtggcgcttcctggcccgggacgagggagaatctgcagtagctgaggaccccacatggggtgaggacgaggagccttcggcatgcacgacggactcctgggctcagggttcagtgcccgtgctgcacgcgtccacctcggagggcctggagaacttccaaggcgaagaccctgggggcgtggaccggatccctttaggaaggtcgtggatgggtcgaggctcccaggagcagatggaatcttgggagccttctccgcagctgagagtcacgtcggcccctcctcccacatcagagctgtttcaggaggcagggcccggaggtcctgtagaggaagcggacggccagtctagaggcctctcctcggccgggtccttgagcgcgagcttccaactgtcggtggaggaggcgcctgccgacgatgccgacccttctctggatccgtacctggtagccagcccccaggcctcaactgggaggggacaccccctcggcttccatttgtcgttggaagacctctactgttgcatgcctcaactggacgcggctggggatcggctggaactcaggtcagagggggtgccctgcatcgcctcgggcgtgttggtgtcctacccctctgtgggcggcgccacccgcccctccgcgtcctgccagcagcagcgggccgggcactcggatgtgcggctgagcgcccaccaccacaggatgcgccgcaaggcggccgtgaaacgcctggaccctgcgaggctcccgtgccactgggtgcgccctctggctgaggtcctggtcccagactctcaaacacgccccttggaagcctaccgcggacgccagcggggcgagaagaccaaggcccgggccgaaccccaagccctcggccccggcacccgtgtctccccggcagcgttcttccctctccggccaggcattcctttccgtgacttggactcgggccccgcactcctgttccccactttaaatttaggcctatcgtcgccatccctcgagtcaaagctgccactcccaaactccaggatccgcttcctcaccacacacccggtgctccctgatgtggcccgcagccgcagccccaagctgtggcccagtgtcaggtggcccagcggttgggaggggaaggccgagctgctgggcgagctgtgggctggccggacccgcgtgcctccacagggtctggagctggcagacagggagggccaggatcctggcagatggcctcgaaccacacccccggtccttgaagccacttcccaggtgatgtggaagcccgtgttgctgccagaagccctgaagctggcccctggtgtgagcatgtggaaccggagcacccaggtgttgctcagctctggtgtgcctgaacaagaggacaaagaaggtagcacctttcctcccgttgagcaacatcccatccagacaggtgccccaaagcccaggtgaccgtagcacagctaatgaagaactcagcccccaaagtgtggtcacgctcctctaagcctgctgcctccctctgatccctgagcctctggcagtagtaactggtccctccctctgctagccagaaataaacacctgagttgccttaggaact

SEQ ID NO: 1587 - DNA, 357 bp, Homo sapiens
aatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggaatgctgatacctgattctagttatggatatggaggcaaggagaagttgttaggttaaccagcgcagtcctccgtgcgtcccgcccgccgctgccctcactcccggccaggatggcatcctgtctggccctgcgcatggcgctgctgctggtctccggggttctggcccc

SEQ ID NO: 1588 - DNA, 1844 bp, Homo sapiens
ttttgtatttgaatgcgcatgtgtgtgtccttttaaaactctttccatttgtacaatgacagatttcagattggagttaatctgagcatggaagactatgccctgacgtttggaattaatcccttcattgccttgatgattcaacccatcgtgacgatgactgtggttgacaaccaaggactggggcttcctgttgacattcagcacaaagcaaagccctcgccaaaagccagccagatgctgccacctgatcttggacctcccagcttccagaacttattaagtccatctgagaaactagagccttgggacccagggatgaggaaacttaccgtacagacatgcgggctgaccttcattcaccctgcgggccatggcctctgccatccaactgcagaggcttcagccgaaactctctccagcactgccctaaacagaccaagtgtgagggagggagcatgtaatgaaaagtccacagagaacaagaagccacaagattcggtgctctggagccattctagatggtttcaggggaactagcttcccacctctgacagggataccatggcaaataccactctttgcctaggattataattctttgtgcacaatgcatcccatcccaaagacagtccacagcaggacttgctccatctctgaactggtcttacccccttaaacctgcctttatatctaggagtttctttattttattttatttttttgagacagagtctcgctccattgcccaggctggactgcagcggcgtgatctcagctcactgcaacctccacctcctgggttcaagtgattcttgtgcctcagcctcccaagtagctgggattaaaggcacgtgccaccatgactggccaatttttatatttttagtagagatgaggtttcaccatgttggccaggctggtctcaaactcttgacttcaagtgatccgcccgcctcagcctcccaaagtgctgggattacaggtgtgagccaccaggcccagcctatatctaggagtctcttgatgagcattggtcgacagaaagaagtctcttctaaaaattgttaatgcttttatagactactcatagtctgagtcataaaacatcatttgcctttcaatttataccttccaagtgaatatgattattgaggattatctaattattatctacgtttctctctagatataaaaaacaccatagatcctatacacacaaaaatggtttttctatcagaaatggactcactcgcctggcaaaaggacacagattagattattctaatctcaaggccccttaggcttatgaattcaaaaaaaaaaatagaagaaatgaacaaaaacttaaatcacagtttgttattaagtaatatctgaaatgaattagaaagaaaccataagccttaacaatactccaatcacagttaaattaatttagacagaaaagcaaatagcaattgacttgaaaataagaagtggagccgaaggtggatacaagaaatccaggagggctaagataaatcccaaatccaatgttcatcaatgcctacacattcagtacaacctgatggcattaattctgtggttggggaaatgtgaaagtgaaatcgataataccacagttctaaatgtgcactgttggctgaacttatggtgtggtggggggtggtaaaaattaggcttctaagaaaggatgggactctgccctccaggcaaggagtaaatggccccagcagatggaaaactaaagcaaatgtaatcacctgcattttgaaaataggtgtgtttctgagaatttgtttgaattagttctttgtaaataaaacaggattttgaatgca

SEQ ID NO: 1589 - DNA, 2086 bp, Homo sapiens
atcccacggaatgttaaaatacattgcaccatcccatttgtctatttcttcagtctatctctgctaaaagagctttcagaaagaaactgtcaatagaaacctgggcttcctcagcagaccaaagccttgagaagaacacaattcgctgttttgtatttgaatgcgcatgtgtgtgtccttttaaaactctttccatttgtacaatgacagatttcagattggagttaatctgagcatggaagactatgccctgacgtttggaattaatcccttcattgccttgatgattcaacccatcgtgacgatgactgtggttgacaaccaaggactggggcttcctgttgacattcagcacaaagcaaagccctcgccaaaagccagccagatgctgccacctgatcttggacctcccagcttccagaactgcttcacctgtagaactgccccctcccttgtgatggttctcagctggaagagcggggtcaggagagaagtgccagttcatccatcttacgctaagtattaagtccatctgagaaactagagccttgggacccagggatgaggaaacttaccgtacagacatgcgggctgaccttcattcaccctgcgggccatggcctctgccatccaactgcagaggcttcagccgaaactctctccagcactgccctaaacagaccaagtgtgagggagggagcatgtaatgaaaagtccacagagaacaagaagccacaagattcggtgctctggagccattctagatggtttcaggggaactagcttcccacctctgacagggataccatggcaaataccactctttgcctaggattataattctttgtgcacaatgcatcccatcccaaagacagtccacagcaggacttgctccatctctgaactggtcttacccccttaaacctgcctttatatctaggagtttctttattttattttatttttttgagacagagtctcgctccattgcccaggctggactgcagcggcgtgatctcagctcactgcaacctccacctcctgggttcaagtgattcttgtgcctcagcctcccaagtagctgggattaaaggcacgtgccaccatgactggccaatttttatatttttagtagagatgaggtttcaccatgttggccaggctggtctcaaactcttgacttcaagtgatccgcccgcctcagcctcccaaagtgctgggattacaggtgtgagccaccaggcccagcctatatctaggagtctcttgatgagcattggtcgacagaaagaagtctcttctaaaaattgttaatgcttttatagactactcatagtctgagtcataaaacatcatttgcctttcaatttataccttccaagtgaatatgattattgaggattatctaattattatctacgtttctctctagatataaaaaacaccatagatcctatacacacaaaaatggtttttctatcagaaatggactcactcgcctggcaaaaggacacagattagattattctaatctcaaggccccttaggcttatgaattcaaaaaaaaaaatagaagaaatgaacaaaaacttaaatcacagtttgttattaagtaatatctgaaatgaattagaaagaaaccataagccttaacaatactccaatcacagttaaattaatttagacagaaaagcaaatagcaattgacttgaaaataagaagtggagccgaaggtggatacaagaaatccaggagggctaagataaatcccaaatccaatgttcatcaatgcctacacattcagtacaacctgatggcattaattctgtggttggggaaatgtgaaagtgaaatcgataataccacagttctaaatgtgcactgttggctgaacttatggtgtggtggggggtggtaaaaattaggcttctaagaaaggatgggactctgccctccaggcaaggagtaaatggccccagcagatggaaaactaaagcaaatgtaatcacctgcattttgaaaataggtgtgtttctgagaatttgtttgaattagttctttgtaaataaaacaggattttgaatgc

SEQ ID NO: 1590 - DNA, 1774 bp, Homo sapiens
ggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctatgcagacaagaaacagaaaagaaaagagaaaaagacggccgacctaagtcaggctgcgtttgaaaggcagttcctttcctcaaagctcagccagaagaacaaagtgggtgaaagaaagggtctggtgagcagaggcctggggcggggctggcatgcagggctttgcagcacccacgagcagcacatactggttccagaatgagccaccgccacagccctccctgtcagacaggcacccaagggcggaggaggcatggcccaagaagaagggtgtgaagaggaggagggagaaatggcggtggcctcaggctcagcactgcagctctgacagggcccctcgggcggggaagccttgcatgaagaaactcagacaagtggtaaatgtgggacctggaccccactttccggagacatcctgtccttccgaggtgagggccaacctggccacaggggcttttccccctgagatttcttcagcgccttcgcccgggcctttgcccttctgccactttcctaccattttccacttactccatccaaactgcaccaaagatggtgttctccttagtccacacacaactggtgggaagtttttgaaatgaaatttataccaaaaaattagggcaagatgagattttttgatatttaaaaggtatttttatatgtaggaattttctgagtatggatttcttatccagagctcatggttcatttgacacagttttcagctcctggtctatttccccttccattctctccgccacgccctgtgccctgaggcctgaggcgcaggaccctcccagggaaggcctagggggcttggtgggccaccgctcagctcaggacctgacagcgtcactcccaccctcaccaccacacacacaggatgggggactgctgctgctttccagcctgtgagcctggataggtattttgtgacccagctcctgctcagtcccatcgctgtccccggtctctccagggagtaagggattctccgtctgtggtaagttacctgtgactcttcagcagtttcctctgagcataattatatctgagagcacagggagctcctcattccatgtatttttcaaatattcaagatgtacaacgtgatgatttgctataggtattcattgtgaaatgtttgccacagtcaagcttgttgacatacccaccagctcacatttactgttttcgtgtgtgtggtgagaatactcacaatctactctctgagcaaactgcaaatatatgttattagtaactgta

SEQ ID NO: 1591 - DNA, 4035 bp, Homo sapiens
acatgctgccacttggctgagccgggcgccggcgagaaggcggcgccgctgccctggcagctggactgcactttgcccccgcccggcctcagctgccgcccgcccagacgccagcaagcccccctcccacgacagggctgctccgggagcttcggagacccgccccgggcctgagcgcaggctgcctccgggaccccacggctgtccggacgtgccatgggcgcgcagctgccgggcaacgtgttgtgtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaactggtgtgaaaaagtacaaataactatctggatttaaaaatgtgtctacgataatgtcactattataagaacaactaggatgaaatgcattttaagtacttctatgttaacagcaatttctgtttagtcttagattttagtcatctgaagggctgaacagaggtcctgtgacacccaataatcagctgaatgtcacagcacttcttcctaagtaatggcatcaccaaagaaaatgctaaggaataaaaactgccccaaattccaatggttgaagtttatcctttaaaataacaatttttgtttgtttatacccaaaaaaagtccagatatgaaaagggcttttctaaaatttcttggcgagggaatggcactcaaatcatagtgattaacagtaagtcttgtttgtttgtcaaggatctctacttcttgacacaaatgaaccctgtctttaataagataagatatttatttttgtagatgagaagtgtaactaccaccttggacctcagggccctaactaattacagctgttactggacgactcagactttgtgcctaaagccatcttagagataacagtttatagaagccatgacattagtgtttattgcattgaattaagcccagtgatataactatacaagaaaacaagtaggggtaccttttacaaagagcaatccaataaatcttaaaaataacagaaacttagtctgcaaggtagaaagtttcagttttaattctgtattaagctttactatctcagaggtacagagggctggaatatgggcatttatttccagttttttcttgactagtaaggcggtcaccattaaaatagaccagataatgcatgaagatttacagttgtattgcaaaacggaaaagataaaactgtcctttgaggagagtactcgttttctgggtttttgttattttttagtggtaacacaagcctatagggcatttatagccacctattatactgtttccataagcctggctaccttttagggaagctattttttctctttcatttttactgtcacagcacatacacacacacctttttgttttaaaggattaagtactgtttgaagatcagtggtaacagaaaatttgggagggagaagaagaaattaagacatgacttgttagaaaattaagacttcagtttctagaattatcttttcatcaagatttggtagacattgagtttaaatggaaaggaaattatttaagcctgtgtatgttagatccacaatacaccattggtattgaaatataaaggttaaaaaaaaggcttatgacctctttaatgagataaatatgtatttgtcttgtaagcaggcagaaaatctacctctaattttaacactaatactttgaaacccacaatcaaatagagtgaattctccaagttacataagcaaggaaaacattatttgaaatatgccatgttttcgttgcctttggacacctcatcattcaactctaattttaccgagtcccgggatttgtactgtcccattgtacttgcaatctacaatttatataatagaaaaacaaccaaacccattcatacaaggatctgaagttataaggttaagggcagaaagtttcccataagtataaaacatttccaggtcatgaagagtagtttaggttgagtgacaaaagcctaggtgtggttgtttttcattcattttgcatctcacaccaagacatttttgctgcaaggtcatctgctgcttaaaatgtacaattaggtatataaaataagtacaatggtgaaaacacaaagccaggtaaagcagcatgccccactaaacttttcagtatacatagggacagacaagtgagttttggttgtatctaaatattttaatttcaggttccttctgtgccctgggccactatttcccaggggtgtgacagagatgcctgccagatccatatcaactagaagtctgatttctgttgctgcccttcctcagcaactatggcagtatacttttatcaccaagcaccactcccttgtccctgaatcacattttaatagagtacaatatcttctgtacaatatttctgaaacacttatgtctgaaatatatgctgtattgtatgttaacccatgacatatatgaactacaaggcttgcataatcagtgagctagtggataaatcaagacaggagcaaatgggagaaagatgaataaacaaatgaaaaaagatgaataaatgaataagagagatgaataaacaaatttacattacatgtgatagttatcatggtatggccttcatgacaagatggatgagaatatcactgataggatattagccttctttcatatctttatattgaaatatgggctttacttcaatttgaaggtctttcatgaacaataaaagagagtagaaggactgtctgagaaggcaggagacatataaaacagatgactgaaagactgactagctcctggaaagggaaacatttggaacatccagagtaagggcaaatgggcttctaccagcacaacaaagagcctccaggtggcaacatggaagcaggttatcagagaaaataaatgtgcaaattccttatttacaatgactcacttaaccccacaaacatgtttcactgctgccttccccagttgtcgcttatgtactgttgttacctttcagttacatgcctttgatcctaaaattctctacttttgttgccttatcagttctttgcaatctgcctgtggttatcagcacttaaagcacaattttgaaggggaaaaaaatgataatcaccttagtcccaaagaaataatttgtcaaactgccttattagtattaaaaacagacacactgaatgaagtagcatgatacgcatatatcctactcagtatcattggccttttatcaaatggggaaactatacttttgtattacatagttttagaaatcgaaagttagagactctttataagtaatgtcaaggaacagtaatttaaaaacaaagttctaacaaatatattgtttgcttaatcacaatgccctcaacttgtatttgaataactaaataggacatgtcttccttggagctgtgggcattagttcagaagcactacctgcatcttaattttcaaaacttaagttttattagcaaatcctcttctctgtaagacttagctatgaagtggtatattttttccaaatatttttctgaaaacatttgttgttgtaactgcacaataaaagtccagttgcaattaa

SEQ ID NO: 1592 - DNA, 998 bp, Homo sapiens
gggagccagctgttgtcatcattcaggagctatcagcctatttctacatactttatatctgttttggattatttggattccagttgtaagcctccatttagaaagggagcatgagaagcactgaaaagtaaggcactgtgatctacacggaaaccatatattgggctcacagctactgaatgagaccgactggtggagacagtttagtgaacctggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaactggtgtgaaaaagtacaaataactatctggatttaaaaatgtgtctacgataatgtcactattataagaacaactaggatgaaatgcattttaagtacttctatgttaacagcaatttctgtttagtcttagattttagtcatctgaagggctgaacagaggtcctgtgacacccaataatcagctgaatgtcacagcacttcttcctaagtaatggcatcaccaaagaaaatgctaaggaataaaaactgccccaaattccaa

SEQ ID NO: 1593 - DNA, 570 bp, Homo sapiens
attcgaattgttacaaagttcagctagagatttccttctccctgtggagtttcactccctgctcctctggtcaccctcctgatggatctctgtggtgccaggcaggaatggcctgctaggggatgcagcgagatcccaggtcctttctgctgcttcctctaccactgtttttcactcggctctccaaattgactcagctccaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcagga

SEQ ID NO: 1594 - DNA, 1441 bp, Homo sapiens
tttcattgacctctgcgatgcctcgctggcttctgctttcattgacctttgcgggtctgttcccgctgcggcgccggcagctgcttggtagttgcggggggcgtgagggcggtggcccagaccaaccggctggcagcccagctccgctccgcccgcccctgcctcggaccctgcgcctgaggaagtatcgaggcaaccctctgccacccgaagttcgtgggtcgctcccagagggcgcgccctggagccgagcgcccttgggcggccatctggaggccaggtgcgggccgcgaacccgcgaggagcgcgcggcgggcgcggcggcgacggcaggaggaggggccgggagcccgggcgccgccgaaggacgccccgtcctccacatgctgccacttggctgagccgggcgccggcgagaaggcggcgccgctgccctggcagctggactgcactttgcccccgcccggcctcagctgccgcccgcccagacgccagcaagcccccctcccacgacagggctgctccgggagcttcggagacccgccccgggcctgagcgcaggctgcctccgggaccccacggctgtccggacgtgccatgggcgcgcagctgccgggcaacgtgttgtgtaagtgaacatctgggaggtgggtgactggtgaagggcgggtgtctgtcggtctttgcttgtcagctgtgccttttagatttttcaatggcagaaacccatgagttacaggaggctttaattaaacgagaccgttctcagccagctgccgtggatagagcctcacatctccgtcccctaatcgagaagagttagcccctaccccttcaattttgttctgggcttcccagtgaaaggtatctcattatgagttgcaattccaccctgctgcctacctgaagagtgagtgaagattttcaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagc

SEQ ID NO: 1595 - DNA, 692 bp, Homo sapiens
ctgccgcccgcccagacgccagcaagcccccctcccacgacagggctgctccgggagcttcggagacccgccccgggcctgagcgcaggctgcctccgggaccccacggctgtccggacgtgccatgggcgcgcagctgccgggcaacgtgttgtgtaagtgaacatctgggaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaa

SEQ ID NO: 1596 - DNA, 486 bp, Homo sapiens
cagaatagactagttcatatatccaagagcagggctcctgaagggcatggactctagcttattacagacataccctggcatctagcacaatacctggcacataatagcctccatttagaaagggagcatgagaagcactgaaaagtaaggcactgtgatctacacggaaaccatatattgggctcacagctactgaatgagaccgactggtggagacagtttagtgaacctggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgcca

SEQ ID NO: 1597 - DNA, 3721 bp, Homo sapiens
ttcaagcaagtcacccaggtcaagcctgttctagaagaaacaactatagcaaaagccctaaggttggagtgtggctgccagagctcacacatggtgaggatgtccagaccattattcctcgattgggcctggagacccctctgcagcccctcccaatctctcccactgacctacggaccagaaggctggattttgcaatggaagggaacttgcaggcagcagacagctctgcactgtccctttgattttcctcaggcacctctgagagggagacacactctcagccaagtacccaacaagggacatgagaaggcttctgctgtgcagctgccagagaaacaggggacagatcaaagcaggagaggaccaacatctgcggtaaccaaagcaaggacaagttaccctgagtcagaaaccttcattgtgtatttgtgcagttacttttggaactcaagtaaaggagtttacatgtcaggttccacctgaattccttccatgcttttcagcgactgaaccatttgggtggcctggaagagcctgtgagctccctggagaaaggagacagtgtggatggagaagaatctggagtagagaggagtctggggaccctgcctttcaagtcgtttgtgtgagggctgcgttggtggcccaactagccagggaagggctatggtatgcggggtcaggcgggaataggcaggaaatgtttgtgataagaggcttcgcctcttgcaagctcctctggtttccagacccagctgcaggataagggcccaggagctgagcagggagcctcagaggaggctgctgcaagagccagctcttgggatttcagcaggcagagttgcaatcagaggcccctggggtccctgaagaccatgcctggggatagaaacgaccctgggaacccagccagggctgccttcctttgggatcagggattttcaatcatacttcagagggccaaatcaatcccttaagaaaaataaaacaaaacaaaccccagctttgttaatccaagttgctgagagggtgggaagtacagacttgaccccccaggggatttcatgcgctggattggtcccagttggagccattcattaatgttaaccagtagaaatggaaaatggaagggtgcactgacaaaagaccaggctggaagctctgagaaggaatctatcccaaagggatcatctgctggggataaatagagtcatcgaacagtgtgtcatgcaggcatttgcaaagcttggtgctccttagatttccagtgtcgcctctttgcccaaggcccagtgactccaccatctgtggttgacttggccagctcacaaaggagcaagatgtgcttcacaggaacaccccatgagcggggatgaggctacaggccacttgctattgtaccagctccccttcttaaggattagcagcttctatctatccctggaggctgcactgtaaatgcctgtgtaatgctaatttgtggttggcaggagattgattgggaaggagcaggacaatggcaagaggaggctgagctccctcctcctcctggtgtaatggtgtgcttgcatgctgtgtgtgtgtgtgtgtgtgtgtgtgtgtgtgtacgtgtgtgtacgtgtgtgtcttctgggagaaatgtagcaacaagcccacagaagagatgattattcaaagagaggaagaagatttactcaccgatgcccagaatctgaaaggcatgtctggagtggagagatgggagtctatgaagcacaaatccagggagattttttgatgggaataagtgacaacccatcactcttaacatattctattcattagaaccaagtccctaagtccagcccacgcttagaggaagggattacatgggaggcaagaatcactgagagccatttcggaaactgcctacacttagaaaaacacttcaagagctcccggccaagggcctggcacatagcaagtgctcaaggaattgttacttggaccagtgactcttctaggatgtgatctaggttttcccatagtggcctgggtctctgctgtcccatctttattcctgttggcactgctgggttttcagcaaaggctttttcctctgacactgggaggtttgtgactaggctctctgggtgtgggccagcagacaggatagacgctaacttacactcttgctgtcttccgaacagcctcttcatgaccatgtgtggtcttactttgtggtcagtgtacagatattttaatttcctgctcacctgctcagaggaggatctgatttcttcttgcatttatttttctctccggcagcctgtggacaggtatttctgtctgaccatctggtagccattcacctttatggtggcttgagaaaggaatcaatttcacttgtttctttagtaatatctgcctcttttgacagcaagttacctttatcacctcttaaaattcttactatgttgcaccttctgttaccttgggggctctttcaatcccctaactttgtgcaactgcatctccctctttggtttagcttctcaggcctttctttttgcaccacggtttaatacattccatatatacttctaagtctgctggtacctctccccacccactgcctgctgagagtgacggattcttcctggctggaccaagtctaaagtaatcagaaaacaactgaaagaggaaagctgacccctgccctcatcctgcccctctgcagacttcttgaggccttttgtctaattgtggtgggtaatgtgggcagggtaaaaaatggggaagatagagcaaattttctgggcaagaatgaggggagaggtgagtggagcgtcttcatctcgctctggttttgtatcatgggtgtctccagggcctactgtctcctctgagactcctagaaagtgaggagccatggattggtatcctactaacagatggaacatcagaggcccgtggtaaggagtataataagctcagctcgccatgctctgttttgtttttgttggaagaagtgttgaaaaaaggagtggttatacactggcctatctagctatagaatacaaacacttagggtgagcagcagggaatgccttttctgaaaatgatgctgcatggaatggatgattaattccctggttaaaatgaagccagactatctttcagagtcttaagcctcctcccaataccctccacatactagtttctaattggttaatgaatatggtcactatttctagggcctgttgctccagtgtagtggtcaagagtgtacactcctatttacaatagcaaagacatggaaccaacccaaatgcccatcaatgatagactggatgaagaaaatattgtacatatataccatggaatactatgcagccctaagaaggaatgagatcgtgtcctttgcagggacatggatgaagctggaagccatcatcctcagcaaactaacacaggaacagaaaaccaaataccacacgttctcactcataagtgggagctgaacagtgagaacacatggacacagggaggggaacatcacacaccaaggcctgtctggtgtggggaggggagggagagcatcaggacaaatagctaatgcatgtggggcttaaacctagatgacgggttgataggtgcagcaatccactatggcacacatatacctatgtaacaaaccataccttctgcacatgtatcccagaacttaaagtaaaat

SEQ ID NO: 1598 - DNA, 1572 bp, Homo sapiens
ggctggtttggatccgggtcagtcgggtgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctcta

SEQ ID NO: 1599 - DNA, 1617 bp, Homo sapiens
gaaagaactttgtgctttggctgcagcgctgcgagtataaagggatgagtgggttgcacggagagggctatgaagaaaaacacaaatggaagtatcaaccttactggtttctagaccaactggggagattcccgttaaaaatgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcagaaatgatgtacacctgatagcaagaagctaattcatatgctttaaaccaatgaaggcttgtcaaagagatttagttaatggcagaccttgtggccactttgtgtgagaagacatctctttctgctcactgtgcttgcaataaaaacttttcttggcatctcagttaatcttcattctttcaacttactctcttgagttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctcta

SEQ ID NO: 1600 - DNA, 971 bp, Homo sapiens
ggagctgggccgccagttccgggactggtgcttgcgcacctacggcgactcggccaaaaccaagacggtgacacgcagcaaataccagcggatcgccgaggtcctgcagggcggcggcgggactggcgcgggcagcggccccgcagccggcgagaaaggcaagttccagttctgggtgcgctccaagggcttccgcctgggcagcggccgggaacccaagatgggccaagtggtgtatgtgccggtcaagacgggctcgggggcagatggcctgtcggagccagagggcatctctctgaagcgggtcgctgtggtggaagatttctttgacatcatctactcgatgcatgtggagagctcagcggagccaggcaaagcccccaagcacgctgggcagaagaaaacctaccgagcgatcgcagagacctatgccttcctcccgagagaggccgtgacccggttcctgatgagctgtacggagtgtcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcagtgcctcccttcaggagccgaggacatcatgtctggtggccccactttggaggctgctgaatttgatgacttgattgggaagtgtctgccagatcgccccattgcagagtgaggatggacagttcccgcgtttggaaacacatttcctggatgaacttaagagctgtggccactagttcgttctaaaaatcattattgggcaccagcatgtgtggataaataaagcctcccacctgccccacatcaccaaggatgagaagatccagtaaactggggagagtgaattggtttgaaaacacatttgatttcaggaataaaaggtgcaaatgagtaaa

SEQ ID NO: 1601 - DNA, 701 bp, Homo sapiens
ggcgccgccgccgctgccgccgctgctcgcctgggccctcctcctggccacccccgcccccgggccgggcagtgacgcgccgcggtggtgccagcccctctccccgggcagccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattattaaaattga

SEQ ID NO: 1602 - DNA, 5991 bp, Homo sapiens
ccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccaccacccccacgcccaccccctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagcaaaacaaaagaggcaccccgaccccattctacagaagccccagtccatggtcacctgtattctacctcacactccagcgtgggctttttccaggatgtgccctgagcctgttctgaacagctgtaaccccaactcccccacacaatgtgtctgcctgggaggtaagtaagtccagactgggtgtccaggagctggaacccagagagcgtcctgtccctaaccagccactgcagccctccagctctggccctcagctgcttgacaggacggactgctgggagatggcagccggttggcagggcccttgccctcacaccccgctgcccaggagccaggtctgaacttctgtgcacaggcctggcccctcagactcactcctgccaagaggggccacttcttcagggtgagccccggctatcaggcagccgtgagctccagggcgggctgcagctcccatccccttgcgccatgtttggagtaaagggatcagtggaagtggaggagccacttgggttctcctaagaccagcccttccggaggggccggtcctggaagaaacccataatccctggagtgtgaaaaagggcaaaaagaaaaagctggcctggtttccttcctccctgattgattgattgataggcacttcctcttgctcagtgcaatacctaccagtgctgctaaaccagggactcgcccagacctcagcaggcccccagggcctctccgtgcaacactccgtagccatgacagcagctctctgctgcccgcccctgcccagagctggcagaagccctctgttgcctttcctccctcagagcagagaggccccaggggagccagggccgagtggatcctaggatggccacggagagccactcgctcccagaacaggcaccccttcccaaaccagcttttctgcagccaattgcctgttgcagctgtggccactgcctcccggcactgtggcagactccccccaaggagggatggggggggcaccagtgaggatgccccatcctgcctcaggtccagaactctgaaaggtagggtgcccaccccgtgcttacttccggcccctagaggttgggggtggtcgttatctctcaagtggcctccaataccccatccagccacaccacctctgccttccatctgaccaatccccaggcctctggtcagggccaggacacctgagactcacccttagcacagcacaacctccagtgcccaaggcctctcccacaccccagccatccacacatctggccccacctgctcagtactactcaacatttgaattcgtgtaaatatttatttttgtgtgtgaacaatactacaaagtaatcagtaagatcttttgcaaaaatgttaccccaggcaattatttgtgaaaatcttaatgttaaaacctggcagagacaatcgccaccctagaattcctggtatcagttacttaacgtgtcacttctcctcccagaggcagtacccaagctagacatgaaccgtttgcatttcttggcagacaggagtgagaaagactggggaaggggctccctccccctacccacacaaggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttacaaaatagtaaagtatttcaccagaataccagtttcaatccgtccatggtctgatttttatataatttagtggtgctttagaaactttgtttttgttgtttctgagctaaacagctcaatcctttttcgcctgtatctacctaagaccaatgtgaacctttgtatttttgctcctaattttggactcagtgaaagtgtactgtttacatgtacagatgcccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccgaa

SEQ ID NO: 1603 - DNA, 1620 bp, Homo sapiens
ccccctccagccccacctcttcccccggccctgggtggggcccgcacctggggctctccgctcgttagcgcgcccagggcgcctcctcggcccgagagggacccgcccgcggggcctggctggctcagggctacctccttccgcctaggacccccccttcggtgactcccgattccctgtcctaggctgcggtgccccgggaggcgggtcgccagagtagcagacagagctctttaatgggtgtcttctagggcgggtgctgtttgtgcatcatttgggttcccacacacttcctatgaggtggcgaaagccattatgcctatggtgtctgctcacacagggggaaactgaggcccaggcaggacagccccttgcctggggtgggggctgggttgtccttaggcctgtgacttcacctctacagcaccctcctgtggaccctctccctgcccccgccaggccagagtcctgcagccaggcccagaccctggcctgtccgtccggggatgctggacagtactcctccctccagccctcataagtcattgtcattcggatctgcatttccccagcccctctccttctaactggggggcactgtggcccactgtgcccctttctcttcccattccttccccctacacccattccagacatcccagagttaacaaaacccaaaagaaagagaaaaaagactcagagctgcttggaggagatgacatcctcaaatgtagcgccgttgtttgaggggctggtcccaggcacctttctctgtggcctggggtgtgcgttttggtccccagcgtgatttgaaagaagatggaggttcagcgaagcagaaaggaggtcttggaatatgtgaggcctgttccagatggcaggtgcgactcggtggtggcggtggcggcggcagctacgcgctaacagttggagattgtgcacaagggtggagaagagttacctccctggctcaatcatggagacattctgatcagcagttctcaaaatctgtcttgcatcagaatcatctgggggggcctgttaaaacccccagcacatcagatttgggttctccttgaaggccacgtagacatcctggcgttcttcccctagggtgtagcacacatggaatccaggtggccctagctcaccagaggacagttcaagggggcagatggcctgtcggagccagagggcatctctctgaagcgggtcgctgtggtggaagatttctttgacatcatctactcgatgcatgtggagagctcagcggagccaggcaaagcccccaagcacgctgggcagaagaaaacctaccgagcgatcgcagagacctatgccttcctcccgagagaggccgtgacccggttcctgatgagctgtacggagtgtcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcagccatcctcactgtctccggcacctggcttcgtaaacactgttatcaccgtgctcatctgtgcccatgaagaatga

SEQ ID NO: 1604 - DNA, 541 bp, Homo sapiens
gcccctcacctccacctacctgaagcagatgaagcttcgagtgatgaattcccaggagcaggatgagacttctgtgagcagcgaggattttgatatgagcgactccacatggatgtcagctgacccgcacctggcctccagcctgagccccagccaggacgagaggatgcggagcccgcagaacctccacagtcaagaggacgggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattattaaaattga

SEQ ID NO: 1605 - DNA, 2042 bp, Homo sapiens
ccccctccagccccacctcttcccccggccctgggtggggcccgcacctggggctctccgctcgttagcgcgcccagggcgcctcctcggcccgagagggacccgcccgcggggcctggctggctcagggctacctccttccgcctaggacccccccttcggtgactcccgattccctgtcctaggctgcggtgccccgggaggcgggtcgccagagtagcagacagagctctttaatgggtgtcttctagggcgggtgctgtttgtgcatcatttgggttcccacacacttcctatgaggtggcgaaagccattatgcctatggtgtctgctcacacagggggaaactgaggcccaggcaggacagccccttgcctggggtgggggctgggttgtccttaggcctgtgacttcacctctacagcaccctcctgtggaccctctccctgcccccgccaggccagagtcctgcagccaggcccagaccctggcctgtccgtccggggatgctggacagtactcctccctccagccctcataagtcattgtcattcggatctgcatttccccagcccctctccttctaactggggggcactgtggcccactgtgcccctttctcttcccattccttccccctacacccattccagacatcccagagttaacaaaacccaaaagaaagagaaaaaagactcagagctgcttggaggagatgacatcctcaaatgtagcgccgttgtttgaggggctggtcccaggcacctttctctgtggcctggggtgtgcgttttggtccccagcgtgatttgaaagaagatggaggttcagcgaagcagaaaggaggtcttggaatatgtgaggcctgttccagatggcaggtgcgactcggtggtggcggtggcggcggcagctacgcgctaacagttggagattgtgcacaagggtggagaagagttacctccctggctcaatcatggagacattctgatcagcagttctcaaaatctgtcttgcatcagaatcatctgggggggcctgttaaaacccccagcacatcagatttgggttctccttgaaggccacgtagacatcctggcgttcttcccctagggtgtagcacacatggaatccaggtggccctagctcaccagaggacagttcaagggggcagatggcctgtcggagccagagggcatctctctgaagcgggtcgctgtggtggaagatttctttgacatcatctactcgatgcatgtggagagctcagcggagccaggcaaagcccccaagcacgctgggcagaagaaaacctaccgagcgatcgcagagacctatgccttcctcccgagagaggccgtgacccggttcctgatgagctgtacggagtgtcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcaggatgagacttctgtgagcagcgaggattttgatatgagcgactccacatggatgtcagctgacccgcacctggcctccagcctgagccccagccaggacgagaggatgcggagcccgcagaacctccacagtcaagaggacggtggtgtctgtctccagggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattattaaaattga

SEQ ID NO: 1606 - DNA, 1354 bp, Homo sapiens
ctctccccgggcagccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccaccacccccacgcccaggttgggggctcccctgacaaggcgctggggctgcagctctgtttag

SEQ ID NO: 1607 - DNA, 311 bp, Homo sapiens
tcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcagccatcctcactgtctccggcacctggcttcgtaaacactgttatcaccgtgctcatctgtgcccatgaagaatgaagcacaaaaccgcacaaacagccggaagcacagccccctggttttgtttcatacagaatggcactaaatccaggtcaccact

SEQ ID NO: 1608 - DNA, 2823 bp, Homo sapiens
aggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttgaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgtt

SEQ ID NO: 1609 - DNA, 3425 bp, Homo sapiens
aggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttgaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgtta

SEQ ID NO: 1610 - DNA, 2088 bp, Homo sapiens
accaaccccgccaggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgtaagcccttgagctttgcccctctaatgtcagcccctcccaggatgactgaccccacaccccagtggagagtgttccttttggtccctctcaaagcctgcatctgtcatccatttataagtctacagtgtttctgccaagggattgacatggagggagctggggagagtgaaggagtcagaatgccttaatacaaactcgtccaacctgc

SEQ ID NO: 1611 - DNA, 3336 bp, Homo sapiens
atgcccctgtcccgcaggggaaggggatcccgcctggccggctctcgagcggcgactagtaacctcccgcgggcgacagccctctccccaaagcacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttgaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgtt

SEQ ID NO: 1612 - DNA, 2227 bp, Homo sapiens
ctgcaacacagagtgtctttacaggcagacgtttcaggcattctctgagatgctccagagtttggtggtaaaagacccacatttggaaaatcttgacaccattattaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttgaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgtta

SEQ ID NO: 1613 - DNA, 2000 bp, Homo sapiens
gcacccctcccccaggcaccaaccccgccaggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgtaagcccttgagctttgcccctctaatgtcagcccctcccaggatgactgaccccacaccccagtggagagtgttccttttggtccctctcaaagcctgcatctgtcatccatttataagtctacagtgtttctgccaagggattgacatggagggagctggggagagtgaaggagtcagaatgccttaatacaaactcgtccaacctgc

SEQ ID NO: 1614 - DNA, 675 bp, Homo sapiens
gctgcccggcccattttaaaggaacaggaagggtctcgtcgggaggggatagcttagaagggatttttttttcctctttagaaaattgtggcagtttctggccgggcgcagtggctcacgcctgtaatcccagaactttgggaggccgaggcgggcggattacctgaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaaga

SEQ ID NO: 1615 - DNA, 531 bp, Homo sapiens
ccggagtccgagccgcgggctgacttccgctcgggaaagtggctccaagagcccgccacaggggacgccagggactcgcggcaggctctgcgggccaggatgagttctaagcacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaa

SEQ ID NO: 1616 - DNA, 3303 bp, Homo sapiens
gccggctctcgagcggcgactagtacctcccgcggggccctctcccaaagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcacttggtcccctggttacagtcagtcaaagaccatgagcgggaacgggccacggccagcatggctcaagttctgaagtgcctatccaaacatctcaacttgaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaccctgaaacatccctgcatccagcgatcagcaggagaattactgctaactttggcaaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgcaacagatgccctttatgaggtgtttttgggaaacaggcttcgagcagctacgttccgactctttcctcagcttctcatgacactgcttatccagattcatcacagcatcggcctcaccatgtctgatgtcgacatcccaagtggcctgtacacagaacaggaagtgccttcagaggtcacccctttgtgctttgccatgcaggctacaaagactctcctcctcagaacatgctgcttgcaggaattcaacatcatggaaaagaataaaggatgggctctcctgggaggaaaagatggccatcttcagggactatttctccttgccaacgcattgctggaaagaaatcagctccttgcacagaaggtcatgtacttattagtccctcttcttaaccgagggaatgataaacataaactcacatctgcaggcttttttgtggagcttctccggagtccagtggccaagagactgcccagcatatactctgttgcccgctttaaagactggctacaagatggaaatcatctctttagaattctcggcctgaggggactgtacaatcttgttggacaccaggagatgagagaagacatcaagagcctgttgccatacattgtagacagcttgcgtgaaaccgatgagaagatcgttctgtcagccatccagatactcctgcaacttgttagaacaatggatttcactaccctggctgccatgatgaggaccctgttctccttatttggtgatgtgagatctgatgttcatcgtttctccgtgactctctttggagccgccataaagtctgtaaaaaacccagataagaagagtatagagaaccaagtcctggacagcttggtcccactacttctgtattctcaggatgaaaatgatgcagtagctgaggagagcaggcaagtcctaactatatgtgcccagttcctgaagtggaagctgccccaagaagtgtactccaaagatccctggcacatcaaacctactgaagcaggaacaatctgcagattctttggaaaaaaagtgcaaggggaaaattaacatcctagaacaaacactgatgtactccaagaacccaaaacttcccatcagaagatcagcagtcttgtttgtaggccttttatcgaagtacatggatcacaatgagctcaggaggatgggtactgactggatagaggacgatctgagagacctgctgtgtgaccctgagccctcgctgtgcatcatcgcttcccagactctgttactagtccagatggcgagggccgaaccaaaacctaagcagagagtgaactggttgcagaagctcatgggcaggtcctctgcctagaaacacaaggcaagcaacatcagagacagaatcttgctatgttgtgcggcaagctagtcttgaactcatggcctcaagtcatcctcctgtgtcagcctcccaaagtgctgggattacaagcatgcaccacggcacccagcagaattccagtcttgagaaacaggtcaaggacagcttcaaaagagattctaaataaatgttaatgttacaatgtt

SEQ ID NO: 1617 - DNA, 571 bp, Homo sapiens
gggcccagggggcagagcagacggagtgtgggccatcgtccccagtggtgaccagccctgccatgggaaactatagttcccacaaaaggaccaaagcacccaagcaggcccgcaaggagaggccggctgacatggacaaggcctggtggaaatcgttcctcaaccacctcactcggaagaagccggctaccaggatcgtgctgattctccccctggacaagcggcagccgctggccaacgctgggcaacggattgactacgcgtccggcgctgggctgggctccccggcggcacccagattgcgcggagcgggcgaaggtagcgagcgcgagccgaggatgccggtactgctgctgctgcggcggcaagaggcgcggcggccggaagagggcggggccagggcagctctgagctggccgcggctgctctcgcgcttccggtccccggggaaggctccccgcgaagccggccccgccgaggagcagccgcgcaaacggtgccgctgccctcgcccgcagctttaaacgcttggcccggaccccgcccaataaagagtgcgtggcaaccctgg

SEQ ID NO: 1618 - DNA, 2793 bp, Homo sapiens
ttctctctccctgtgaagagcgtgggggactccgcgcagaggtcgacagaggttgaggcagggccaggagccatgatggacacagaggggcagtagaggctgcaggcgtctccacaaccccagcgcagaggggcccgggccagggccacagggagccatggagagcttcatggagtcgctgaacaggctgaaggagatccacgagaaggaagtcctgggcctgcagaacaagcttctggaactgaactcagagaggtgccgggacgcccagaggatcgaggagctcttctccaagaaccaccagctccgggaacagcagaagacactgaaggagaacctgcgggtgctggagaacaggctgcgggccggcctgtgcgaccgctgcatggtcacccaggagctggccaggaagcggcagcaggagttcgagagctcccacctgcagaacctgcagcgcatcttcatcctcaccaacgagatgaacgggctgaaggaagagaacgagaccttgaaggaggaggtgaagcggcttcggggcctgggagacaggcccaagccccgggccaaggagggcacctcggaccccccctcacccctgctgctcccctcccctggtggctggaaggccatcacagagaagccaccgggaggccacgaggaggctgaggaagaccaccagggcgtgggcctacggggagaagaaaagccagcagggcacaggacatctccagtggccaaaatctccccaggggccaccctgcctgagtcgcgagccccagacatgagcccccagcgcatctccaaccagctgcacgggaccattgccgtggtgcggcctgggtcccaggcttgccctgccgaccgaggccccgccaatgggacgcccccaccactgcccgccaggagcagcccacccagcccagcgtatgagcgtggcctctccctggacagcttcctgcgggcctcccggccctccgccatgacccatgaggccccgaagctctccccgaaggtggaccggctctgcctcctaaaccgccccctgtccctgcaccttcagagcccccacagcagccccctggcccctgctgcagcccccagcgacccccggctccaggacctgaaggccagagaagcagaggcctgggaggagcccacagaactgctggggctgcccagtgccctggcgggcatgcaggaccttcgcctggagggggcactgcacctgctcctggcccagcagcagctgcgggctagggccagggcaggcagtgtcaggccaaggggccagcccacacccggggagatgctgccctccctaccagtcggctcagactctgagggccctgagaatgaggggaccagggcagctctggccgcagcaggcctgtctggagggcggcacacacagcctgcaggcccgggccgcgcccagaggacagaggctgcagccacgcaggactgtgccctagacaagcccctggacctctcggagtggggccgggcccggggccaggacactcccaagccggccggccagcatgggtcactcagccctgccgctgcccacactgccagccccgagccacccacccagtccggacccctgactcgcagtccccaggcactcagcaatggcaccaaggggaccagagtgccagagcaggaggaggcttccactcccatggacccctcacgcccacttccagggtcccagctcagcctgtcctctccaggcagtacagaagatgaagacacagggaggcctctgccacctccccacccacagccgcctccccacccacagccgcctgacctggacggccacccagagcccagcaaggctgaagtgctgagaccagagtccgacgaactggatgagacagacaccccaggcagcgaggtgggcctgagctcccaggcggaggccactacgagcacgaccggggaggggcctgagtgcatctgcacccaggagcacgggcagggtccaccacggaagaggaagcgggcctcggagcctggggacaaagcctccaaaaagccatccagagggagaaggaaactgacagccactgaggggcccgggagcccaagggacgccgaggaccacagtccctcccccaacagcagcccctgggaggagacctagccagcctgcaccagggtccacagcgagcccggggcagccctccacctgcccaccagggcctggagagggcacaccatccaaccagcaggcagccctgcacagaaccctgggagaagacctagccagcctcagctgaacccacagtgagcccagggcagctctctgcctgctcaccacagcctggagagggcacaccacccaaccagcaggcaaccccgaagagccggtgacgggcacatcctggcccacttcaagaggggctggaggaccgagaggggtctcaggctggcgattcaccccgtctccacccacctgggaaatgctctgcggcccctcccacagcccagcacctgctccctgaggggtgtggggactggaggcgggatcactcaggctccagcccagccctacccctgctgtgcactgcagccgttcccaggcagtgcccacgctctgggaggcaacggaccactcggacccccacccctgcccgccaagctccaagcacaatcttggacgccccctcgtgggctgacagcaaacagatgtctggcagtgagggtggagggagacagtgggcggcagcaccctcgaagaccgggtcccctgagtgacggagaataaacacttgaagaaccgtg

SEQ ID NO: 1619 - DNA, 1927 bp, Homo sapiens
agctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttggccttccttccagagggtgaatgcgacacacgacccttgatcctgatgagcctgggaaatgagttgatacggataaggaaggaaatattttatgaactgattgacaatgatgacgagatgataaaaaagttgttaaagctcaatattgcattccccagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattggg

SEQ ID NO: 1620 - DNA, 1956 bp, Homo sapiens
agagcagggcttccagtagctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttgggtcttcaccaggccttccttccagagggtgaatgcgacacacgacccttgatcctgatgagcctgggaaatgagttgatacggataaggaaggaaatattttatgaactgattgacaatgatgacgagatgataaaaaagttgttaaagctcaatattgcattccccagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattggg

SEQ ID NO: 1621 - DNA, 1722 bp, Homo sapiens
ggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttgtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtcctt

SEQ ID NO: 1622 - DNA, 2523 bp, Homo sapiens
tcaccatggaatatgaagtcaagaaagggaagaagggctttgtatcccccatccgaaggctggtgttccccaaggccgggcgccgggcagcctgtaggagcagcgtgagccgccggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggcagctgaaggagctgccgctgaagaccacggcggagcaggacagcatcctgagcctgtctgcccgctgcctgctgctcacctggcgcgacaatgaagagctcattctgcgaatccctacgcacgagatcgccgccgcctcctacctgcaggacgacgcgctgcacctgctagtgctcaagaccggtctgggtgtggacccggtgccggccggcgtggatgccagcccaggcggcgcaggacgcgaccccggcccgccaggcggggcgcccgagaagcggcgggtgggcaccgcggagcggcgccacaccatctgcagcctggactggcggatggggtggggtgggggcgccgcggaggcccgggccgggggaggcggcggcggcagcttggagcgccagcgcgccggggcgcgggcgtcgggcagctgggagcgacggcagacgttcagcggcagctgggagcggcggcacggaggcggcggcggcggcggcggcgcgggaaagccgggcggtagctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcataatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaa

SEQ ID NO: 1623 - DNA, 2596 bp, Homo sapiens
gggacatttcaccatggaatatgaagtcaagaaagggaagaagggctttgtatcccccatccgaaggctggtgttccccaaggccgggcgccgggcagcctgtaggagcagcgtgagccgccggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggcagctgaaggagctgccgctgaagaccacggcggagcaggacagcatcctgagcctgtctgcccgctgcctgctgctcacctggcgcgacaatgaagagctcattctgcgaatccctacgcacgagatcgccgccgcctcctacctgcaggacgacgcgctgcacctgctagtgctcaagaccggtctgggtgtggacccggtgccggccggcgtggatgccagcccaggcggcgcaggacgcgaccccggcccgccaggcggggcgcccgagaagcggcgggtgggcaccgcggagcggcgccacaccatctgcagcctggactggcggatggggtggggtgggggcgccgcggaggcccgggccgggggaggcggcggcggcagcttggagcgccagcgcgccggggcgcgggcgtcgggcagctgggagcgacggcagacgttcagcggcagctgggagcggcggcacggaggcggcggcggcggcggcggcgcgggaaagccgggcggtagctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcagtgagagctgccacacagatgggacgtatgcctatgatgccgacttcagctgctgcagctcctttaatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaac

SEQ ID NO: 1624 - DNA, 721 bp, Homo sapiens
gggacatttcaccatggaatatgaagtcaagaaagggaagaagggctttgtatcccccatccgaaggctggtgttccccaaggccgggcgccgggcagcctgtaggagcagcgtgagccgccggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggcagctgaaggagctgccgctgaagaccacggcggagcaggacagcatcctgagcctgtctgcccgctgcctgctgctcacctggcgcgacaatgaagagctcattctgcgaatccctacgcacgagatcgccgccgcctcctacctgcaggacgacgcgctgcacctgctagtgctcaagaccggtctgggtgtggacccggtgccggccggcgtggatgccagcccaggcggcgcaggacgcgaccccggcccgccaggcggggcgcccgagaagcggcgggtgggcaccgcggagcggcgccacaccatctgcagcctggactggcggatggggtggggtgggggcgccgcggaggccccaacccgctcgacccgcaggaccccagccccgacgcctactgcaacctggtcatcctggctgtag

SEQ ID NO: 1625 - DNA, 1841 bp, Homo sapiens
gagcggcggcacggaggcggcggcggcggcggcggcgcgggaaagccgggcggtagctgggagcggaggcaggcgggcagcggcgggggaggcagctgggagcggcgccaccccggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcagtgagagctgccacacagatgggacgtatgcctatgatgccgacttcagctgctgcagctcctttaatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaa

SEQ ID NO: 1626 - DNA, 426 bp, Homo sapiens
tcgcctgcatcttcggagagaggtgctgagcccttcctcatggatacggggtcccgggaggcagccttcaccagggacctgcccaggaaaccagcagatgcccaggtcagccctgaaatgtccattactcacaaagaaaaggaaaatgctcatttgaaagaaattcttctctttgtcaatgctgaggcattctctcagccccagccccacagtgctccagtgtgtgaagggcaacagctgacggggaagttcagcacatctgtgctgaccagggctggaggcgatgccagtccgtgcagctgggaacgcctcctctgctatggctggagccactgctgaagggactccacctggcacctatgccaccaatggcccctgaacgggtatctaggcccacccttaataaagatgagctgctcattccca

SEQ ID NO: 1627 - DNA, 1107 bp, Homo sapiens
gacccgaggggggcccccacgcccgctctggcctctcaggtcaggccctcccctcccctcccctcccctcccccgcccctgtgtctccgcgagccggctgtgtgcctgcgagagcgtgcacacccgcgggaccttcccttttgttccaccctgacctctaccttctctaccttgtgctgaccccgctggggtgcaggggttcccttcggaggaggccggggctcaaggtgtgcagctcggccgcctctccctaactctgcaccagcgccttctctctctctctctctctctctctctctctctctctctctcaagatctccctcctgctaagtctgcgctgctgcaggagggctgggggaagggcaggggtgtggagagggggtgcctggtgtcttctttctctctctgcccccaccaagtgcggacgcatcgagcttcggcccccacccctgcattcgcgattggctcccggaggaggtggctggtgctgccgccgctgcagcatctcctagggagccgcgaccctgcgcccgccgccgctgccgctgtcaccagcccggccccaggggtgccctgggctccgcggctgaggcacctagggagttgcccccctagtggacggcctctcaggagatcctgaccaccctctgggaacctggactcctccaagcatcgtctttctcgcctgcatcttcggagagaggtgctgagcccttcctcatggatacggggtcccgggaggcagccttcaccagggacctgcccaggaaaccagcagatgcccaggtcagccctgaaatgtccattactcacaaagaaaaggaaaatgctcatttgaaagaaattcttctctttgtcaatgctgaggcattctctcagccccagccccacagtgctccagtgtgtgaagggcaacagctgacggggaagttcagcacatctgtgctgaccagggctggaggcgatgccagtccgtgcagctgggaacgcctcctctgctatggctggagccactgctgaagggactccacctggcacctatgccaccaatggcccctgaacgggtatctaggcccacccttaataaagatgagctgctcattccc

SEQ ID NO: 1628 - DNA, 1220 bp, Homo sapiens
gacccgaggggggcccccacgcccgctctggcctctcaggtcaggccctcccctcccctcccctcccctcccccgcccctgtgtctccgcgagccggctgtgtgcctgcgagagcgtgcacacccgcgggaccttcccttttgttccaccctgacctctaccttctctaccttgtgctgaccccgctggggtgcaggggttcccttcggaggaggccggggctcaaggtgtgcagctcggccgcctctccctaactctgcaccagcgccttctctctctctctctctctctctctctctctctctctctctcaagatctccctcctgctaagtctgcgctgctgcaggagggctgggggaagggcaggggtgtggagagggggtgcctggtgtcttctttctctctctgcccccaccaagtgcggacgcatcgagcttcggcccccacccctgcattcgcgattggctcccggaggaggtggctggtgctgccgccgctgcagcatctcctagggagccgcgaccctgcgcccgccgccgctgccgctgtcaccagcccggccccaggggtgccctgggctccgcggctgaggcacctagggagttgcccccctagtggacggcctctcaggagatcctgaccaccctctgggaacctggactcctccaagcatcgtctttctcgcctgcatcttcggagagaggtgctgagcccttcctcatggatacggggtcccgggaggcagccttcaccagggacctgcccaggaaaccagcagatgcccagctgtagctgtgcattgatggcgccgtgcggcccggccgcaggtcccgcagccgtggagaggacccagcaggtggcgcggggagagcccggctcggcacgtggtcagctccaagtcagccctgaaatgtccattactcacaaagaaaaggaaaatgctcatttgaaagaaattcttctctttgtcaatgctgaggcattctctcagccccagccccacagtgctccagtgtgtgaagggcaacagctgacggggaagttcagcacatctgtgctgaccagggctggaggcgatgccagtccgtgcagctgggaacgcctcctctgctatggctggagccactgctgaagggactccacctggcacctatgccaccaatggcccctgaacgggtatctaggcccacccttaataaagatgagctgctcattccca

SEQ ID NO: 1629 - DNA, 1034 bp, Homo sapiens
acatgctgtctctctgccctggcctcttccaccccatgcccagtcagagaccgttttgaggcattgcgactgcccttggttcagttccgggaagtgtggctgcccttctgagaccctcaactgctcctcctgccaccacacagccgacgaatggaactggcttgatgcgtgctccaggaagactatggggtacctgatgaggacaagagagtctatgacctctgacactgtgctctggtggttggtcagtggtcaacactgggcccggccatatcccccatgctttccgggcctcacccatctcccactttccgcccaaatccctgcccttggccctgtcttcacagcctctggatggagatctcacccacccagctctgttttctctcccctgggcccagcccccaatctccctcttgctgtttccagggcatgaactcagggagcgagcttgggaaattgtggaggaagctgtttaaagggattcccaggctctcggtgagccattttgatttctattgtgggacttgtgtgctgttggggcgcccacagatcccgcagggctccagccttggcaacgacatcgaccaataccccgtggttttcaggaatgccagcgaccagggctcctggatgcagctggagatgctactgcggaagctctctgacctggtgtggacttcagatgctctaagtgataagattttggaagatggtctggttccctagtggagtggaagatagcaaagacacggtcaccctctttggatttggatcagaatagcaaggaaagtgtttctatcactggaaggaggataatcagaccaagggctccaaggaaatactgcccacgtctagtgcaggagcagaaatcgaagtcatccatcagctagcgtgtggacaagctcactattcacacaagctcagcctagctgagtccatacaaatcctatttctgggtgggtaaagggcaggaggaaattgtaagatcagtctggtactgaataaaatcctggcctgattgtcttacctgt

SEQ ID NO: 1630 - DNA, 1059 bp, Homo sapiens
actgaggtattccttcccctctcaggactagccacatgctgtctctctgccctggcctcttccaccccatgcccagtcagagaccgttttgagggtagagaagccagtctacggcccaccacgggagccaccgcctgggccagacatgaagcgctggcagatttttgtcctgtgggtcttttgggtgctcatcctctggctgatgaccccctatctggatctgacacctgaatcagcaccccaggaaaaacgaatgtacttggtaccacagcattgcgactgcccttggttcagttccgggaagtgtggctgcccttctgagaccctcaactgctcctcctgccaccacacagccgacgaatggaactggcttgatgcgtgctccaggaagactatggggtacctgatgaggacaagagagtctatgacctctgacactgtgctctggtggttgggcatgaactcagggagcgagcttgggaaattgtggaggaagctgtttaaagggattcccaggctctcggtgagccattttgatttctattgtgggacttgtgtgctgttggggcgcccacagatcccgcagggctccagccttggcaacgacatcgaccaataccccgtggttttcaggaatgccagcgaccagggctcctggatgcagctggagatgctactgcggaagctctctgacctggtgtggacttcagatgctctaagtgataagattttggaagatggtctggttccctagtggagtggaagatagcaaagacacggtcaccctctttggatttggatcagaatagcaaggaaagtgtttctatcactggaaggaggataatcagaccaagggctccaaggaaatactgcccacgtctagtgcaggagcagaaatcgaagtcatccatcagctagcgtgtggacaagctcactattcacacaagctcagcctagctgagtccatacaaatcctatttctgggtgggtaaagggcaggaggaaattgtaagatcagtctggtactgaataaaatcctggcctgattgtcttacctgt

SEQ ID NO: 1631 - DNA, 5152 bp, Homo sapiens
atcccccccacccccgccaacgctcgccggggtcgcccgaggcctgagccaagggggacgctgtgggcgcggctcaggccaggccctcagtgctctggctattgctgaaaacaccttctagttccaccttgtaactggactcccaaaagatgaatgctgacatcttctgatgcttaacaagaaataaaaatagtcaccttaatcatcaaaaagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttgtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttgttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatattgtctgga

SEQ ID NO: 1632 - DNA, 5036 bp, Homo sapiens
ctgccgcagcgcgccgcagccgggcgtccccgcgcgggcgccggagaggaaggaaggctggcagcctcgtcacgtgtccgctgcagtcgcgaaacagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttgtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttgttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatattgtctgga

SEQ ID NO: 1633 - DNA, 419 bp, Homo sapiens
tgaaaaaccaacccgatactggtggtaggaccatttgcaatcaatagttactgacagtattctgttgcttctagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaact

SEQ ID NO: 1634 - DNA, 446 bp, Homo sapiens
agaaggctgcaaggagtcctgtgggaggccctggggtcttattagttgaaggaaacaaatcatcatacctttaatactggctccaatttgcccctttcatgagtagtcttggagagataattgctaatctggaatggacatacttcttgatcttggttggcatttttcaaactgtgatgaagacactttttatagccctgttcagaatacagaaggagacctactcttctttgatcacaatctaaagacagacagaggacatgtggaaagatctgtcatggattaaatataaacaaaaatgaagcaagaaacaaaactagtctttcaatgaaaagctgaagatgctgaagaagaaatgcaaaatcatttcacaagaaaaacaaaatcagaccaggatcacttggcgtaccatcctagcaaaatatatcttcttggagttgccctga

SEQ ID NO: 1635 - DNA, 126 bp, Homo sapiens
gatcttggttggcatttttcaaactgtgatgaagacactttttatagccctgttcagaatacagaaggagacctactcttctttgatcacaatctaaagacagacagaggacatgtggaaaggtaa

SEQ ID NO: 1636 - DNA, 1119 bp, Homo sapiens
ccgcggagtgcggagggaggctgggctctgggaagtccgcgcgcggctccgcttcagaggcaggctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaagaagcaaacctatttatgttttaaa

SEQ ID NO: 1637 - DNA, 1137 bp, Homo sapiens
ggaagaggccccagcactgacctccgtgggggtggagatgaggaggatggaaagggtgtcttcctccagcatcttcctgaagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaagaagcaaacctatttatgttttaaa

SEQ ID NO: 1638 - DNA, 1154 bp, Homo sapiens
ccgcgttccggttgcggatggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggcagtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaa

SEQ ID NO: 1639 - DNA, 539 bp, Homo sapiens
gttccggttgcggatggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtctgcaagtgcctgtctcagaaaatcactcaactaagaggccaggagagccaaaagtatgccctccgccagcagaatgtaatgaaagacctgtaa

SEQ ID NO: 1640 - DNA, 585 bp, Homo sapiens
gcttccgcgttccggttgcggatggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagcagatctctgagaatgcttcattgtcttaggcagaaaaacatcttacctaagcaaagctttcaggaggaacttcaaaggacagcttacctggcacagcaatgacaaggagctgtttcctggatgtctttttgttattgttgctgttaatctcaggtctctttctaatctccctcaaaatgaattcagaagcaggggaatatttggttcaacaaagagagagtggaatttttttttgttttgttcttttaaaacttcagaaaatagcaatgtgggcctgttatgtgtgatgagtaataaaaatagagactttagcat

SEQ ID NO: 1641 - DNA, 627 bp, Homo sapiens
agttttctggagtgctttggaggagagatggagtctcactcttgtagcccaagctggagtacaatgacaatctcagctcactgcaacctccgtcttccatcagcttcccaaagtgttgggattacaggcgtaagccaccacatctggcctaggattttctatatgactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtctgcaagtgcctgtctcagaaaatcactcaactaagaggccaggagagccaaaagtatgccctccgcagttttcaaatggcccgggtgatcttcaac

SEQ ID NO: 1642 - DNA, 501 bp, Homo sapiens
ggcggcttttctcctcagttttctggagtgctttggaggagagacaaggtcttgctatgttgcccaggctggtcttgaactcctggcctcaagcgatcctcccaacttggcctcgcaaagtgctgggactacaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtc

SEQ ID NO: 1643 - DNA, 1670 bp, Homo sapiens
atggaggtttgctcttgttgcccaggctggagtgcaacggtctccgctcactgcaacctccgcttcgcaagttcaacctcccaaagtgctgggattacaggtatgagccagtgtgcctggccaacttttacctttttgactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggcagtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaatccttgactcagagtctacttctgggagaattcaccctgagagaacatgcttctgtgagatgaggttttagaaggatacaaagctctacaccgaatcaggtataaggaattatatcaagttgtaaaactgagaccatgtcattgagaatacatgtcctaaaataatataaagattgaaatacagttgagaaaagtatatcacatcttgatcacacccttgcctcctctccaaagctagaaatccatgttttatcatactaactgggtgtggaaggaacatttggacaatctaaaataacagcgaaaattcacaattctttttaaaatctcttgtcttttatcagattgcaaacgtgaaaggtgagaaggtaacaaatgtgcaccacccaccacagtatatgtaagcacaattatgctacgctaggctgatgccacgtggccttgtcaagttgtgtttgaaga

SEQ ID NO: 1644 - DNA, 2732 bp, Homo sapiens
atatcctgcctgagcctgggccgggtggaggtgtcctgcatggagtcttgtgaaatcgcgtggactgcaacacccagcagcgcgccgccctgggtcctgccactgagcagctgttggtaggctctgctgtgaggtctcctcttccggctttcccacttcccaagtgttggttaaggaatccagatgttactgcaataaccactccataaacaaaaggaacacccagctgtgagaactggcttctcagcattcgtcccagcagaggctcttctggggccagccctggaagaacccatcagggttctgatggttgccctgtttcagcacagcccttattggcaggcagacggctacgggcacagccacaggctgaagtgtcaacacttcaaacaacacagacagtacaatgacaaattggagatcagctctaatctcggcccccaatttaatgcattgctgaatattcttctgaacatagtccatcccacactgtcccatgacacaagacgctccaaggggctgaagatagagggacttctgcagtcaagagagctgggaaactcttggacagtcacaatgtgcatttgggtattaaaggctctgcaaagttctgcaccaaataaacccttggattggcttgatccaatgccatgtttccaaaacctacttgcccgtgggacaccttagtccataacacaggttggcatttcttctagagagtgtgctgtgaaaaacactggtctcacagcaccgtgcattcatccagcaggtatttaccaagcagggactttgggccaggtccgtgctaggctctgcaggtggaccagccagccctgacctccatggtgtctcttctcatgggagaggctgcacagcagtcattgagaaaacgaagaaacacacaggtactttcagatgctgataatgactaccatgtgctaaaagagctccaggtgttgtctgttttgagacaatcttctcgacaatgagatagaatgaaccatgcaaactttgggggctacgatggttttaggaaagagctagagtgaaaaatcctttgacatatatacatacaaataaagatacatgtgtataattttatgtaattgacatcacattatatgctggcacctgccttttttgcttaatgaaaatgtcaaaggtaatattaccaatcaatcaatatatttcaccatcgtgtttaatttctgcagagcacttattcaagcacatactgcatttttcttagtcactcactggtgggaatagaaagttttctcaggcatgcatttttcccacttctgaaatgatctccttagaataaattccccaaattgtattgctgggttcaaaggcatgaacattttacatttttatacaataatgtcaaactaccttccggaaatgatgctcactttactttccctccaagactgtgtgaaaatgcccattttcctaaatgcttactatgactggtttccaactacattttaattcttgttcaatctgataggcaaaaaatgatatttaatttttatttgattgataatgaccttgaacgtgcccattagccttttgcatgtattcttttatgaaacatctgttcctatccttcgtcaatgttcctcttcatatgttaacttttcttattgatttgttagagcactttgtatattgtgaatattagcttttgtgatcagaattatggaattgttgttgtctttagttttgcttatcaagtttaaagccattcagagatgttgtaaatgtgtatgttgttaaatttatgtcttattttgtgttttctgatgctcatatgtttagaatggtcaagcaatcccaacttatgattacttaaatattctcccatatttgctcttagcattttttttcttttcatgtaaccctttgttctttcaggaatttactttgcggtaagaaatgggctggcttccagttttatgtttcccaaatggtgattcagctgttccatttccatattctcccttattagaaatgaccactatattatgttctaaaatatctgcgtacttgtgtcccttcctataatctcagttcatctctttgagctatcttttgattcctttttcaaaccacactgctttactgaactgtcatcatcttatacatttttaatactcagcaagacaagtttctcaatgccactctttttcagagtttttctggtggttgtaagatgtttattcttctggataaactttagaatcactctttttgtccaaggtaaaatatatcccacattgagatcatactgaatatacagactaattcaggaaaaaatgtatgtctttattgcattgagtcttcttatccaataaaaaagatatgaatttccatgtattgaaatcttcactgagacttatttttggcttttcacatgtcctgcaaatgtattgttaaatttatttttaggtattttaggggaaatgattttctaaagtttgtattttctagcttgttataatttacatatgagatagtcattgttgtatattatttataactgatcatattactgtatttgtattgttttaatagtttttctattattttgggttttcctggaatacaaccttattatctacaaattatgattgttttgccttttccaatgttcataactgtttttatattcttgtctgattgctttgttcagcacttctagaataaagtcatgcaatactaatgat

SEQ ID NO: 1645 - DNA, 868 bp, Homo sapiens
gtgcggaactcaaaaccgactgcggagagcccagcgggcgggagctggggcgcacgttggggccctgccgaggggcgggcagggcccggtgccagccccggcaccgacgggacgccctcctccctccgcagggcgggaggatgccgccgccagcgaaggagggcgggcgcaagggcccgcgggagcgaagcgggaagagcgcgccaggcacggcgcagggtgaggagcgtgccaagggggcgcccgcgacagagccccccaagccgggctgggccctgacgccgcagggactggcggccatgctccctgcgcagcgccaccgccatctgctcttcggcgacctgctggaggacgtgggcgcggcggcctccaccttcccgtgcgggtcggtggaaccggggtaccgcatgcccgacccgcgcccgtggacgcagtcgctcgagctgcccgccgagcgccagaaccggctcctcggcgtcctcaaggcagcggaggcccgcgggcgagtccgcgccctgcggctgcgctacacccgcatgcgggccgaggagatcgcgctgctcatccagcggcagaagtccgcgcgcgccgccatccggctggagctgttcctgccgccgcagctgaagcccgcgcggatcccggaccccctggaccgccaagaggtgcagacaagccccggtaggggcggggaaaggggaggggccctgcccgcctccgcacacgccggaccccagcctctctccccggcagcggaggcgcgtggagaccatcctggaggagaacgtggatggcaccatcttcccgcggtgacggcgactgagagtgtgcgacgcgccccagcctcccacataaagttataattctc

SEQ ID NO: 1646 - DNA, 1604 bp, Homo sapiens
ctcattaactccatcttcagtgatttggccagaacctgctgccagtctgaaagagttgggggaatgtacaagtcaaagatccctcgggcccagaaccaggtcagtgtcaaggtcactcctaagaacactgagatgaaaatagcagaagagcccagcccgagtcttgggcagaccttggagtggctgagaaaggagctgtctgagatgcagattcaagatcagagtctcctgctcacactgaggcatcttcacagtgtcctggaggagctgcgtgcggacagcgcccactgggaggacgccaggtccagcggagggacatcccccatcagagctcgagcgggctccgaaggcaggggctgccagccggtttgctcaaggggtctggcccagctcctccgaggggaagacagcagacgaagctctctcccttaactggacggagatgacactgggctttaacactctccccattagtctaacctttcactgtgatatttcaggggcagagtgttggaatgggagtcagaaagccagggctctgggttcatttctgccctcatctgctgtgcatccctggatctgtcactcagcttctctgtgtctctggttccttttctgtcacttgggatttcttggtgaggcacacataaggtattggatgtgaacacacttttcgactgaaaacacaaatgtgctctagtgctctggcaagcaccatggcagtaaccctatccttgggaatttttcacaaggcaattgttaaaacaaagaactagatgtgcagtaatggttaccaagtgttgctatggtgaaaattccaacccctgtgtagtgacttagtggctgttttctgtcttcccaggaagccttcccattccccttcatctgataacatattaggccctgtaaccaccctggccataggcatgggtatattaccaggcctggccaatgatataattcatggttgccctaaaaagatgattggcccaatggatggtcatgtgaaccaacagagccagtcaccgaccttccctgagattgctacctggaagctctttctattacactcaggctgaggctgctggtggccatgttcctaccaggtaaagaagacctgtctgcagtaggaaggaaagaggctaatctccaaagagaagtagagagagggccacacaacagatggacagagaggaagagcgctggctctttttggtccctggttttaggtcctagttttgtgagttactcctgcattctttccagggaccgaagccagtcaatttcaccccccaacacagccacacacatcaatttgtttttggttaagctgatttgagcagtttccctcatttgcagctagaatggtcttgaggaatatgatccagatgttcaaagaatcaaagaggagaaatcaatatgaaaatggcatttcattcaatgagggtttgtgacaacaacctccgtaacagcaggcaaccaggcttgtgatacagcagagacactcagttgtgtggggtgctgcagtcataactgaaaaattgtatctgcctataagaaagactaaaacagaaaaggtgaaaataaaaaagtcatggtgttaa

SEQ ID NO: 1647 - DNA, 4082 bp, Homo sapiens
ggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgatggaacactgctgcaggcatttgtagctgaagttgcagaacaaatagttggtattgcagtgatcagaaatgaaatggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctatgttcttcagcttctgtgagaagaatgtggattatgaaacgtttaaagccctcaatgatgcatgtcttgtgtatgacagtcgacttgtgattgataccaacttccacaccaacgacatagccatcagagctgctggctccctcaccaaattctccaatagatactactcaaatgagtggactcacagcaacttcagttccaaagaaattggctttcagctggcagcagctatgctacatctctttgatccaacccttgagcctgtgaccgagccaccagctaatcttgaccggctcatccccatgtacaagggagccaagattcaagggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaacttg

SEQ ID NO: 1648 - DNA, 4042 bp, Homo sapiens
accgtttccatggtgaccaggctgcgcgtcctccttgcggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctatgttcttcagcttctgtgagaagaatgtggattatgaaacgtttaaagccctcaatgatgcatgtcttgtgtatgacagtcgacttgtgattgataccaacttccacaccaacgacatagccatcagagctgctggctccctcaccaaattctccaatagatactactcaaatgagtggactcacagcaacttcagttccaaagaaattggctttcagctggcagcagctatgctacatctctttgatccaacccttgagcctgtgaccgagccaccagctaatcttgaccggctcatccccatgtacaagggagccaagattcaagggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaacttg

SEQ ID NO: 1649 - DNA, 3940 bp, Homo sapiens
accgtttccatggtgaccaggctgcgcgtcctccttgcggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggagtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgatggaacactgctgcaggcatttgtagctgaagttgcagaacaaatagttggtattgcagtgatcagaaatgaaatggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctatgttcttcagcttctgtgagaagaatgtggattatgaaacgtttaaagccctcaatgatgcatgtcttgtgtatgacagtcgacttgtgattgataccaacttccacaccaacgacatagccatcagagctgctggctccctcaccaaattctccaatagatactactcaaatgagtggactcacagcaacttcagttccaaagaaattggctttcagctggcagcagctatgctacatctctttgatccaacccttgagcctgtgaccgagccaccagctaatcttgaccggctcatccccatgtacaagggagccaagattcaagggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaacttg

SEQ ID NO: 1650 - DNA, 1059 bp, Homo sapiens
tgcgtataatgcacatgactctcttgaagtgatgacaatgaacagccatggccaagcacccatgcacagatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaa

SEQ ID NO: 1651 - DNA, 3203 bp, Homo sapiens
ggcttaagagagagcctcttcagaactccaagatttggatgtttttctatttttcccagaagaattcgtgttgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgatggaacactgctgcaggcatttgtagctgaagttgcagaacaaatagttggtattgcagtgatcagaaatgaaatggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctatgttcttcagcttctgtgagaagaatgtggattatgaaacgtttaaagccctcaatgatgcatgtcttgtgtatgacagtcgacttgtgattgataccaacttccacaccaacgacatagccatcagagctgctggctccctcaccaaattctccaatagatactactcaaatgagtggactcacagcaacttcagttccaaagaaattggctttcagctggcagcagctatgctacatctctttgatccaacccttgagcctgtgaccgagccaccagctaatcttgaccggctcatccccatgtacaagggagccaagattcaagggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaacttg

SEQ ID NO: 1652 - DNA, 679 bp, Homo sapiens
gcgtggagtgcggcgtcctggagctgcggatgaggtgggtaacgccgtgctgactagcagcgacgcaaggactgcggtgcagggcgtccagggcgcatccccaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagg

SEQ ID NO: 1653 - DNA, 2017 bp, Homo sapiens
ggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaaaaacatttgtctgggaaggagttcatagcatcaccagagtgtcaaagggctctgtggcatgcaagagtttcagacccacggccagagtggacttttcttccttgtgctcagagctagctcggagcaccgtagccacattgcagcccacagggaagggtggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagttacacaggatttcagtaaccttatatgcctctgggaaacaggactgggaattgtaggtgaagatggtgactgactttgcattatgtctatctgttatgtttgatttttttgttttaattaataaacttttttttttttga

SEQ ID NO: 1654 - DNA, 3792 bp, Homo sapiens
accgtttccatggtgaccaggctgcgcgtcctccttgcggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgatggaacactgctgcaggcatttgtagctgaagttgcagaacaaatagttggtattgcagtgatcagaaatgaaatggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaacttg

SEQ ID NO: 1655 - DNA, 3973 bp, Homo sapiens
atggtgaccaggctgcgcgtcctccttgcggcagcgcgtggagtgcggcgtcctggagctgcggatgaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgatggaacactgctgcaggcatttgtagctgaagttgcagaacaaatagttggtattgcagtgatcagaaatgaaatggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctatgttcttcagcttctgtgagaagaatgtggattatgaaacgtttaaagccctcaatgatgcatgtcttgtgtatgacagtcgacttgtgattgataccaacttccacaccaacgacatagccatcagagctgctggctccctcaccaaattctccaatagatactactcaaatgagtggactcacagcaacttcagttccaaagaaattggctttcagctggcagcagctatgctacatctctttgatccaacccttgagcctgtgaccgagccaccagctaatcttgaccggctcatccccatgtacaagggagccaagattcaagggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgt

SEQ ID NO: 1656 - DNA, 2649 bp, Homo sapiens
accgtttccatggtgaccaggctgcgcgtcctccttgcggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgatggaacactgctgcaggcatttgtagctgaagttgcagaacaaatagttggtattgcagtgatcagaaatgaaatggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctga

SEQ ID NO: 1657 - DNA, 1946 bp, Homo sapiens
gataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaaaaacatttgtctgggaaggagttcatagcatcaccagagtgtcaaagggctctgtggcatgcaagagtttcagacccacggccagagtggacttttcttccttgtgctcagagctagctcggagcaccgtagccacattgcagcccacagggaagggtggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagttacacaggatttcagtaaccttatatgcctctgggaaacaggactgggaattgtaggtgaagatggtgactgactttgcattatgtctatctgttatgtttgatttttttgttttaattaataaacttttttttttt

SEQ ID NO: 1658 - DNA, 569 bp, Homo sapiens
agctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcat

SEQ ID NO: 1659 - DNA, 1302 bp, Homo sapiens
tcctgcagccgccgccgctgcagtggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggtaagtgccttcctggcgtggtaggacttgcacaagctcttccggtgggccctggtaggagggccattgctgcaggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccgga

SEQ ID NO: 1660 - DNA, 1116 bp, Homo sapiens
gctcggcgttgagctcctgcagccgccgccgctgcagtggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaagaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccg

SEQ ID NO: 1661 - DNA, 1886 bp, Homo sapiens
gttctgatgcttctccaggccgggccaggcacccgggacgcgtctcgggcccgcacgggggttgcttctttcgagacaggggatggggtggaaggggaagaggtccaaaccctggggtcgaaacaggagtgatggagggttcctcagctcctgaacgagaccaacacggcccgtatcgatggccgaagccggcgtggaagcccagggagaaaggccaccttcgggagctccacccagccccgagacgcgcccgacagccctcccgagagcgaagggcccaagggaggtgcgtcctaagcaaggttcaaggctagaggcgctatcccccaggcggaagaaggagcgggggcggggcctatccgaggccctccttctccctcttcgagtggtcggttctggcccctggcctagttgggccgcctgcccgtcttcctcgcgagagctcgcccggcaggcgcggactagcagggcgctgcctcggcgaccctggcacgtgacgtaggcggccctcgccagttggccgttctttggagcccgctcattggtccggagcgtccctcgccccaccctcccagatcaaccaatgggcggaggcgggggcgtgccgacgggagggcggccgcggcgcggggctcccttcctcgtgctcggcgttgagctcctgcagccgccgccgctgcagtggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccgga

SEQ ID NO: 1662 - DNA, 1734 bp, Homo sapiens
gacgggagggcggccgcggcgcggggctcccttcctcgtgctcggcgttgagctcctgcagccgccgccgctgcagtggtcgtccctgccctccccggccccggggtgcaccccgcaaggtgaggccacccctctgctccctgcctcccggttccttcccgttcgccgaggtcccctcccggtcccggccctgtcctgagcagtcagtgcctgggaccccagcggccgtgatggcagggctggggtggggggctccgctgtcggggccgggcctggaggactccccagcacctgaactagagtgatgtcaggttcccggggcgcagtgaccgttagctggtgcagctggggtgttttccgcgaagcgattgtccgggggcatgagtgcggtagtgagggcgggggcgtaatggggtcagcgccccctcctccccacgaccctgttcattgccgctgcctcgctgcatgaccttggaccagtagcatctctgagcctccgagcctcagcaccctcaggaaggagggcagtgatgtctgggagtgcgggctccggagactcctgcgtcagccgaggctcccgctggtgtccctggagcatgggaggctgctgagcgtgagtggcggtgtctggcaggagctgcgtggcagggagggcgtccatggctgcagccaacaagggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccgga

SEQ ID NO: 1663 - DNA, 933 bp, Homo sapiens
gcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaagaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccgga

SEQ ID NO: 1664 - DNA, 1827 bp, Homo sapiens
attgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgatttta

SEQ ID NO: 1665 - DNA, 1791 bp, Homo sapiens
ccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggacacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgatttta

SEQ ID NO: 1666 - DNA, 1848 bp, Homo sapiens
ggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgatttta

SEQ ID NO: 1667 - DNA, 584 bp, Homo sapiens
gcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgacgtaagctgtcttgaccgctaccatttctctagtagaggcgggacgcggcggcgcggagtgatgacgcgctctgctggcggctggagggttgcggagcacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagca

SEQ ID NO: 1668 - DNA, 2430 bp, Homo sapiens
ccggtgcgtttccgctgtaccggaacgtggggcgaggcgctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 1669 - DNA, 2689 bp, Homo sapiens
cggaacgtggggcgaggcggtgagtgtggcctcctggcctctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccactgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagacaa

SEQ ID NO: 1670 - DNA, 1650 bp, Homo sapiens
agcgtgctgcgtcacggcggtgcgccggaagtggctgcggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcatgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttctctcc

SEQ ID NO: 1671 - DNA, 1476 bp, Homo sapiens
aatcccggaagtgacagctttgggggtttgctgctggctctgactcccgtcctgcgatgggttgcgacgggggaacaatccccaagaggcatgaactggtgaaggggccgaagaaggttgagaagatttggcatttgaagaatgggaaagagtggtgcagtctacacagtgaaggaaaaaacaagaacgggaaggagtgggacatggaatatgatgtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcatgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggcttt

SEQ ID NO: 1672 - DNA, 437 bp, Homo sapiens
gctctgactcccgtcctgcgatgggttgcgacgggggaacaatccccaagaggcatgaactggtgaaggggccgaagaaggttgagaaggcaattattggtgggctcctggatggggcctggtcaccagaaacaccaagccaagattagaagcctggaactttcagccccacctcacccccatccttcagggaggagaagaggaattggacatggagttaataatccatcatgcctacgtggtggggtctccataaagatccctgaagttgagggtttggagattttctgggttgccgacaacatccacatgccaggagagttaccccaactccatgaggacagccctgcacttgggacccttccagattacttctttatctggctatttatttgtatcctttaaaatgtatttgtaataaatcagcaatggtaact

SEQ ID NO: 1673 - DNA, 606 bp, Homo sapiens
gctggagcagccagtgaggacactcagcacagtgtgggcaaccggacaggatggatttgaatttataaagaacctgccttccttccttcatggtccaagcaaatgttccaggtatttaagccacatgctggagaggattataaatatccaagggaaacagagaccatctggagtcatccctacgttgtggaggggtcccacaagagcccattagagagtttgtcacttcacggctgcctggctgccatggctccttccatcacatcctcagaagacagcagcccaagccaaagggacaaaaaagacctctccttggacctattgcttaccagaaagaaaaggtcccaaggcctccactggtctcactggcaaggactgaatcacatgtccatcaggattcacacccctgagcagggctccccgtcccttggacagaattggagttggggtaacaggaaagaaaagggtgttgcacagcgacaagtgcccaccacaggtacccacagcttcttccattgcacctcggaaggcaacaaggagaaaccccatcatttttgagagctttggtgtcattacatttcaataacaaaggtcatttcccttttt

SEQ ID NO: 1674 - DNA, 664 bp, Homo sapiens
ctttgatgtcacaatctgacctgtgggtattaatctggtcacagctgctcacagactagatggcaaggtccaggggactagcacaggaagatgtggaagagaagtgaccatcaacccaagatcaaagcagaggatggacctctggtgggccagttcgaggttctgggttcagttccagaacctgccatgccacatcctctagagctgtcagaatttgagagcttcccagtgtttcaggacattaggcttcacatcagggaagtgggagctcaattggtcaagaaagtcaatgccgtctttcagctggacatcaccaaaaatgggaagaccattttgcggtggaccattgatctgaagaatggttctggggacatgtatccgggacctgccaggctcccagcagacactgtctttacaatcccggagtctgtctttatggagctggttttgggcaaaatgaacccgcagaaggctttccttgccggaaagttcaaagtgagtggcaaggttctgcttagctggaagctggaaagggttttcaaagactgggctaaattttaagcatgcaaaaataccaaggaagaacttctcttcgatgataatgtcgagtggaaatcatgcttaatctgaagattaaagtaaaaagtatccaatatttttactc

SEQ ID NO: 1675 - DNA, 803 bp, Homo sapiens
gagacgcgagacgctgagcccagggccagagcttgcggggcgcacagagcccccaggcctcatggcgcagaaacctctcagcaccgcggcggctgaacgcatgaaccttgtgggtcaggatgagatctggaaataccgtctgaaggctgaatcggaagcacggcagaactggccccagaactgggggtttttaacaaccccttttgaggagttgatcaagtgtgaagaagatctccccaccccaaagcccaaaatcgagcttcctgagcgtttccgcatccggccggtgaccccagtggagaagtacatcaaggtctttccatcccccccagtcccacagaccacccagggcttcatcggctggagatctgcagtgccaggcctgaacaagtgcctagagctcgacgatgcgatcagaagctgcaaaggtgcttttgcacgagagctgtgctggcccaagcagggcgtgcactgaatccagacggagttctgcccaggggtgctgcatatcggtcaccaggcacccagggccatgccagggaaaggaagagctcccctgaatcccgaggacacagtcccctgcgtacttgctcatgggatgttgcaaagaacacaaagtgtgccttagacattctcaagtcatcagcgtcacccttccagaatgttcacgtccacacccattcttggctaatgtaatgaataaggcttctctcatttgtttttgataccttgggaatttctatgcagggctttaaaaaaaaataagtgattcaattttaaaaatatttgtctaggtccttcaa

SEQ ID NO: 1676 - DNA, 1407 bp, Homo sapiens
gcgaaagtgcttcccttaagcttctgaaggttggctgcagttccggctacctgtgtagtccgagtttccacagccaggtactactccgccagtgaccctggacagtaacaaaacatataaagcccgagcccaaaccccgccaccatcataggtctgtagttactgtggaatcaataagccatggcatctaagaaatttgctgttaaatgtgggaattttgctgtcctcgtggatcttcatatcttgccacaaggttcaaacaaagatacaagctggttttctgaacagaagaaagaggaagtctgtttactgttaaaagaaaccattgattcaagagttcaggagtacttggaagttcgcaaacagcacaggccatcaaatgcagaattcacaagatccaatcccttgtccttaaaaggttatggctttcaaatcacagcctatttcctcaagagagggatacgccttcgctgcatcaggagcacacagaatgctgaactctgtgtattccctgacagatttgtggtttgtgtcagtcagcttgcattcagtcgtgatcttttagcaagtcagaatgaagatttgacagaaagagttctccatggagtgtctgattactttgctgagtgtgcagagagttcacttcctcccagtgcaaagctccggagaaatgctctgaaagaaattgtgaaaagaactgaaacaaaaagcagtgtcacgagcaaatcgcagaccagaagagacactgtggaaacatctagtgactcagtgattgcagagatagcaaggaggaggaatgatggtcaggcttcctccagtcccccatcagaatccatgggacaagcaaaggattccataaaggcagctgagagccactgggggcttcctgttcaaaagctggaaaaagttaatcagacccagccagaagacactagtggccagcaaaaacctcatcctggggagcggttaaagacagggcttctaagcaggagccccgtctgtagctgtgagtcagcatcaccatgtccaaaacaaagtccacgagtggccaaaacccaacagaaacgcaggaactgcagctctgcggaagacttcgaccaccacgggagagtttctcttggaagtgatcgattagtcccgagagaaataatagtggaaaaaagcaaagctgtcagggttttgccagcttcagagttgtcagatccagggttacttttgaaacaagatttggcaaaaaccacgtctaaggaagagttgcatgttttggaaagtctctcctccagacatcttatgaaaaataacccagggcaggcacagcaaaccggcttagccacaaacactgaaagattatctacaattcagaacagcccaaccaagaaaagaaagaaatacgaaagaggccattaa

SEQ ID NO: 1677 - DNA, 1575 bp, Homo sapiens
aaagcatcgggtctcgggacttctgagtggcctgggttaccgcgcgatctacactgagacaaggaagttggaaaagccgagtagttataccagaagatcagggtctcacagactcgcaacttctcttccattttccccaatggcgcatgtcttacaaaaacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacctcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtctgacaagattcagaagaagaagaaaaaaattctgagttctgtggtggcggaaacccagcgtccctatgaagaggctctcctacagaagatgtgggaaagccaggacttcctgaaatgcatgcaaaggttcagagaaattattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgc

SEQ ID NO: 1678 - DNA, 1420 bp, Homo sapiens
gggctattgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccgtgtttcacttcaagcccactacggtggtgacaagctgccagccgaagaatccaagagaactacatagaaggcggaagttggaccctgggaagatgcatgccaaaatctggttaatgaagacctcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtctgacaagattcagaagaagaagaaaaaaattctgagttctgtggtggcggaaacccagcgtccctatgaagaggctctcctacagaagatgtgggaaagccaggacttcctgaaatgcatgcaaaggttcagagaaattattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgc

SEQ ID NO: 1679 - DNA, 1022 bp, Homo sapiens
ataccagaagatcagggtctcacagactcgcaacttctcttccattttccccaatggcgcatgtcttacaaaatgtttcacttcaagcccactacggtggtgacaagctgccagccgaagaatccaagagaactacatagaaggcggaagttggaccctgggaagatgcatgccaaaatctggttaatgaagacctcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtctgacaagattcagaagaagaagaaaaaaattctgagttctgtggtggcggaaacccagcgtccctatgaagaggctctcctacagaagatgtgggaaagccaggacttcctgaaatgcatgcaaaggttcagagaagtgcgtgggcaaggaaggtggtggtccctgtagggaagcagtggatgggcagtccccacggcctgtgggaatgagtcaggcttctcctgatctggcgctcaggaggtctctgactctggtgttggcctccctccttgccggtgccattactgtcacttgtctttcatctgggaaggcgattggcactgacctaggccttgcctcattagccagcaatgctggct

SEQ ID NO: 1680 - DNA, 831 bp, Homo sapiens
agaaggggcggggcgatagggatccagagtcttggggatccagagtcttggggctccatgtgagtttgctgtaccggttgtcccggtcacggcatggggcgagcggacactccacgacaccccccgcccccggctgcagggtttggggtccaccggggcgcatttctgatcccagtggctcttcgggtgctcttggccggaagaactcccagacctttcactcctggcctggccgatccacgaagactcgggccccggcgcgtccaagcagcacaatgagtagttcttgacccgaggtcgccctgaaggtgtcgcatgaagagcttgcttcacacacaacaggattcgatactttgccaattcaaggccctggtggctggccgggaaggtggattcgccttggctaggtgccaggcaggtccgcctgtgcgggtgcccctgacttcgacccctagcttatgtcacagcccgaaccagatcgactggtctggtagcagcctgtcactccagactgtcctccaccccagacttccgcaaactgatgggctctttgcgccgtgcagggtgggaggagaagaccaaacgaagtaacgtctgtaaaaccccttcctggacagcgtaaggcctccacatctaagttcctgtcattaaaatggagacagcaaagccgaccctatccagtccttgggactgttatgaacagaaaatgatgcaatgtatgaaaaactgctttgaggagaaaaacaacacagtgtgtttttggaagatgtgattgatttgtaaaccgcattaaatgctctgaaataaaatgaaagtaaaaataagtaaaaa

SEQ ID NO: 1681 - DNA, 714 bp, Homo sapiens
gctgttgagactccaggggtgttcggggctgggagcctgctgagtgttccctgttcccacctccaatctgctccatcctccagctgcatttcattccggatctaccaggatccaactttactactgtcatggagggaattacagtaattctaccaacttttgaggcaaccttcttctgacactgtgtgaaacagactgaaaagactctaaagatggagagagctcaatgcttgagaaaaggaattctgtcctttgaaaggtctctagaacaaaggagtcttattctgtcacctaggctggagtacagtggtgcaatcacagctcactgcagcctcgatctcctggactcaactaatcctcctgcctcagccttctgggtagttgagactacagatacagaagatgagagagagaaaaagagagaaattacagagtgacggagaaggcagacatcatgcaacatgctcaagggctattcattttaagctgaaacatacatgtgtagaaagcatccttgtacttataatcccaatgactatgaagaaaaataatttagccaaatagttcctagaacaggaaaaataaggaattatattttgagataagaagttaagctctagtataacaatgatatgggtcaaagaaaaatgaaaacaaattttaaaaacgttgcaacatgaataaaagtttcaccaaatcgggagtctattataa

SEQ ID NO: 1682 - DNA, 2453 bp, Homo sapiens
gagatgagaagaaagagtaggctctgttgtccctcagacggcgctgctgcagtgcgtcttcgcacttacgcggagcggtaatgtgaggaagcctcccgccaaacagatgagggaggaggaggaggggagaggccagagagagaagcggctttcgggaaggaaagtgtgatctagtaggtggaatagtcctctccaaactttgacctgagaatgaccctctatttggatttggattacacaaagtttaacgttttttggaaaaatcctacctaggtaatgtgtagttctcaatgcatcatgtcaggcagcttatgatgccaatttgtcccatggccttaaattccacaacctcatcatctaccacctttggtgctttcagaatcatgactctcaatgttgaagaatgggctactgcatggaaggtgctgatccttttagaggcagccgtggaagaggaaaagagatcagaagagaaaaggatattggtttgcggaacatgtgggacaagaagttcccagaagaatttgtgagcaacttcccgacagtaaggccctggctagacctcaggatggtccctgcctcctggacattaggaagcccaaaggccagaacaaaaacacatgcctagtgggggaaggctcactaagagggcaccaagtggggcaaatacccctggtaacccatttatggaggctgccacagaaatgctagttggaaattttcctccttcagtctatcatgaatttcttttttctcttttgagatgaagtcgcccgggctgcagttcagtggtgcaatctcagctcactgcaagctctgcctcccaggttccaacgattgtcttgtctcagcctcctgagtagctgagattataagcacgcaccatcatacccgactaatttttgtatttatagtagaaatggggttttgccatgttggccaggctggtcttgaactcctgaccttagggtgatccacccatcttggcctccaaaagtgctgggattacaggcatgagccactgcactcggctgtaccgtgattattagttcaaggttctctttcactggggtaaagaccttaagagagcagtttttgggctttatattctcaatttcccgcacagtgcctagcacatagcaaggactcaacaaatttcattgaatgaatgaaaaaacatagtttaccaaatgtcagtgtactcaaactcttttaactgctagctatagaaatccaattaagactcacttgggtaaaaaaaaataaaaaaataaacaaaataaactgctcacttatttgaaaaattaaggaaggatttcaggcatggcttgatccagctactcaaaaaaggttgtcagaaatgtctgtccgttcttcatttattctttctcatttgtgggctttgttcccagataagatcactccttctggggacaagatggtcactagtagatccaggtttactttctatcagctgagcaacctctcaagaaaaaataaataaataaataaacctctctttaaatagcaccaggctgctgggtgtggtggctcatacctgtaaccccagcactttgggaggctgaggtaggaggattgtgggaagccaggagttcaagaccagcccagccaacattgtgagacataatctctacaaataaaataaattagttggacatgatggtgtgcacctatagtcccagctactcgggaggctgaagcagaaggatcacttgagtctgagaattcggtgttgtttaagccaccctgttgtggtatctgctatggctgcacaggcagaaatagggacacaagtgcaggttcagggcaaggtgtgtgagcacactcagtccctggcctcggagtctctctggatggcttcttgcctagggtgactgacagagggagggatgatatgcaaaggcacctgttctcctcatgacctaaccccaattcttactccacgggttcatgacagcctattctgctggagactgtgtcttaaaacttcctcccctagtttctctcaagtacccctcgtgagctgtgatttcactgggctttgaactcttaggccatttgaggctgcagtgagctatgattgtatcactgcactccagcctagatgacagaacgagaccccatctctaatgaataaataaatatggctgggcacaatggctcaggcctgtaatcccagcatttggaagaccaagacaggcagatcgcttcagctcaggagttcgagatcattctggccaacaaggcgaaaccctgtctctaccaaaaatacaaaaattagccaggcagggtggcatgtgcctttaatcccagctacagggaggctgaggcaggagaatcacttgaacctgggaggcagaggtttcagtgagctgaaattgtgccactgcactccagcctgagtgacagagtgagactttgcaaccaaaaaa

SEQ ID NO: 1683 - DNA, 602 bp, Homo sapiens
cacttacgcggagcggtaatgtgaggaagcctcccgccaaacagatgagggaggaggaggaggggagaggccagagagagaagcggctttcgggaaggaaagtgtgatctagtaggtggaatagtcctctccaaactttgacctgaggtgtgactattgaatgaccctctatttggatttggattacacaaagtttaacgttttttggaaaaatcctacctaggtaatgtgtagttctcaatgcatcatgtcaggcagcttatgatgccaatttgtcccatggccttaaattccacaacctcatcatctaccacctttggtgctttcagaatcatgactctcaatgttgaagaatgggctactgcatggaaggtgctgatccttttagaggcagccgtggaagaggaaaagagatcagaagagaaaaggatattggtttgcggaacatgtgggacaagaagttcccagaagaatttgtgagcaacttcccgacagtaaggccctggctagacctcaggatggtccctgcctcctggacattaggaagcccaaaggccagaacaaaaacacatgcctagtgggggaaggctcactaagagggc

SEQ ID NO: 1684 - DNA, 696 bp, Homo sapiens
agcaatgtcagtgataacaagcaaaaataggacaggggagaaagccaagagtcttcagaccacaagagaaggagagattaattctggaaaatccacctggatggacagcagcagagggaggaggaggcaggacagaccagaagagagacaatgaggttctgaacctagatgttggccaagggagcagaggagggcaggtcaggaggccctcgccctgcaatcacccttcctgggagccttcacttcacctgtgatctcaagacctctccctactgcctgactcgcgccgagcttatggaacatcttcccttgagggtcgcagtccattcgatgagcccttgtcacaggtcctgcttctgtggggagctcaagcgcggacacccttggaacactccccaagtctcttccttcccatccagcaccacttccctaagtcacagctgcaccacctctcatctggactgctcacagcaggtggagtcaggatcaaaatagccaaagaaaaagtaagaatccgtatacaggaaacaaatatgtgatgatgaccggagcagctcagaatcagaacttgagcaagacctgggctgctttgattttctgaaggtctcaaaatattaggggcaaaaaagaaaataaaaaaagaaaaaaaagaaggaataccaaaagcaagttacataaagtatgagatatattaca

SEQ ID NO: 1685 - DNA, 592 bp, Homo sapiens
tggacagcagcagagggaggaggaggcaggacagaccagaagagagacaatgaggttctgaacctagatgttggccaagggagcagaggagggcaggtcaggaggccctcgccctgcaatcacccttcctgggagccttcacttcacctgtgatctcaagacctctccctactgcctgactcgcgccgagcttatggaacatcttcccttgagggtcgcagtccattcgatgagcccttgtcacaggtcctgcttctgtggggagctcaagcgcggacacccttggaacactccccaagtctcttccttcccatccagcaccacttccctaagtcacagctgcaccacctctcatctggactgctcacagcaggtggagtcaggatcaaaatagccaaagaaaaagtaagaatccgtatacaggaaacaaatatgtgatgatgaccggagcagctcagaatcagaacttgagcaagacctgggctgctttgattttctgaaggtctcaaaatattaggggcaaaaaagaaaataaaaaaagaaaaaaaagaaggaataccaaaagcaagttacataaagtatgagatatatt

SEQ ID NO: 1686 - DNA, 2975 bp, Homo sapiens
gcggcaaaaagttcgcgctgctggtcccgcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaagcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtcctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagaattttttttctttttttgagacagtctcgctgcgacgcccaggctatagcgcaatggcgcgatctcggctccctgcaacctccctcaggaagccgtggaagctcgaccgccagaaacttccttctcctgactcaggccacagtcttctgtgtggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaagaagcaa

SEQ ID NO: 1687 - DNA, 1931 bp, Homo sapiens
aaaagttcgcgctgctggtcccgcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaagcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtcctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagaattttttttctttttttgagacagtctcgctgcgacgcccaggctatagcgcaatggcgcgatctcggctccctgcaacctccctcaggaagccgtggaagctcgaccgccagaaacttccttctcctgactcaggccacagtcttctgtgtggtctgggcccctgctgctgacatcccccacatgtcagtctgcctgctagtgggattgactaactcatcaacgtggagtttaatgcccaaccaagtgcagaccacgctcctgttttgcgtcaccctctgcgaagcttcctgcaaacttgactccctgcccagtgcccccagccccaaggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaggccaccctcatgcacataaccctggaagggtcttccagtcatggccatcctgcccggagaggcgcctgtacctggcccaggctggcctgagcctgatgctgggggtgcctctgtggcgttggggctccccgtccccgtgtgcagcagctctgcatcggccttgcaggaacaacacc

SEQ ID NO: 1688 - DNA, 1072 bp, Homo sapiens
ggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagttttgcaggtaggagacaggatgaccagagagttgccactgagctgcagagctccccagggacagccacctggtgctgacatggacgggcaggtgtgaacaccgaagggcccagcgcagctactggcagtaacactcacttctctcagaaccatcttttcgtgcctcttgaaggtgattccagagactctgtgctctcgttaaaagctcaaaccaa

SEQ ID NO: 1689 - DNA, 964 bp, Homo sapiens
ctgtggagtggagaggcgaggcctcacggtggaactctcagatgacagcatgcaggcaccaagagagtggacgcacatacagaagacagccatgcactgagctggggacatgcaacaataacaggccatacaatgaaagtcgctgaagaagaatatgaattttgcctgcggatttgctaacactcgacaatcctaggaggtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagcctttaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatga

SEQ ID NO: 1690 - DNA, 1009 bp, Homo sapiens
accagctgtcaagccagggtgaaggatccgtggccaggcagaggtctgtggagtggagaggcgaggcctcacggtggaactctcagatgtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagcctttaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatgatgaataatttgcagaaggaatctggaaataaggccgtgagataggtatccctacccacaactgtgcctctctccgcaggctccatttgcaacacagccacacataccaataaccagctctctgttctgctctgtgcccaactgcgagaacactttt

SEQ ID NO: 1691 - DNA, 1155 bp, Homo sapiens
cctccgaagacggaaaagaacagcaagtgcaagaccacgcattccaccctggcttgcagattaaaccagctgtcaagccagggtgaaggatccgtggccaggcagaggtctgtggagtggagaggcgaggcctcacggtggaactctcagatgacagcatgcaggcaccaagagagtggacgcacatacagaagacagccatgcactgagctggggacatgcaacaataacaggtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagcctttaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatgatgaataatttgcagaaggaatctggaaataaggccgtgagataggtatccctacccacaactgtgcctctctccgcaggctccatttgcaacacagccacacataccaataaccagctctctgttctgctctgtgcccaactgcgagaacacttttg

SEQ ID NO: 1692 - DNA, 3889 bp, Homo sapiens
aggccatacaatgaaagtcgctgaagaagaatatgaattttgcctgcggatttgctaacactcgacaatcctaggaggtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagcctttaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatgatgaataatttgcagaaggaatctggaaataaggccgtgagataggtatccctacccacaactgtgcctctctccgcaggctccatttgcaacacagccacacataccaataaccagctctctgttctgctctgtgcccaactgcgagaacacttttgaaaaacaaaagaaaaagaaaccaaaaaaccaacttgattccgtccagggacatgtcttgggagccagctaggcttggtctctgcaactagaagcctgcagggaaatgtcccgtcagaaatggagaaagcaatacaccctagagactgcttagtggagctcctcctagaaggtgacccccaagaaacatatcttctttcaaaatactgccttaatttttttctgtttcattttgtgaaattgcttggaattcccctaagtagagaataatcaatttcagaggtttggggactatgagttttataaaatggtcgggcacagtggctcacacctgtaatcccagcactttgggaggccgaggcgggcggatcacctgaggtcgggagttcaagaccagcctgaccaacatggagaaaccccatctctactaaaaatacaaaattagccgggcatggtggcacatgcctgtaatcccagctactcggaggctgagcaggagaatcgcttgaacctgggaggcggaggttgcagtgagccaaaatcgtgccactgcactctacactccagcctgggtgacagagtcagagatcacaccattgcactccagcctgggcaacaagagcgaaactccatctcaaaaaaaaaaaaaataataataataaaatgattaggttctcttaaactgatcttttctaaataccttgctaagaatagatgcaccaagaaataagaggttggagactgtgtttgttggggtggaggtaccacaggcatggatagggtaagaccttaggatcaaatggggggaccagtgttccagagagagggatgcagcagtgaaaattggaggacacaaaacacatttgcatctatctcaaaattttgcttagagcacagcctaactgcaaggaaagttcttcacttctagcctttcacattcttttccttttctttctttgcatggtctgtctttgcccctgctataccatttcaccaatttctcttctcattttcatcttctttctcctactccttttcctcttgctccaaaaatcagaacttagatgaataccattcaagctatgtttaactacattaggggctagcctgggaatttactcaccacttacaacattatttctattgttaaaagtgctcaaattattaacagataattaacaaaaaaacatctaaggctcaatccatttggaaggttaagattgcaaagtgaaggcattttatatgacacggttaacacaaaatgattttatgtgtgctgataaaaggaaccaaagcaacatacttttgaaaaaattaaatggattcattattgtacaaagaaaattttccctcatagagacgcaacttgccattaaagtggactgtaaagaatccatggcttgggaggccgaggcaggcggatcacctgaggtcgggagttcgagaccagcctgaccaacatggagaaaccctgtctctactaaaaatacaaaataagccaggcgtggtggtgcatgcctgtaatcccagctactcaggaggctgaggcaggagagtcacttgaacctgggaggcggaggttgcagtgagccaagattgcgccactgcactccagcctgggcaacaagagcaaaactccatctcaaaaaaaaaaaaagaaaagaaaaaagaatccactgcaattgtgatacaaatgtctaaacctggagtggaatgaatttgaaacattattgcattcatgataccataatgataagaaatagtccatgacttaacaggatatcctggggttgatgactttagatcacatacatcacttttttttttttttcacttaaccttaacatagagtaactgaaataatctgcaatttctacatttgcttaattggtgggggatttagccattcaggctaattagcatgagcccatgtcagtgtttaaattaggccaaaacaaagaccaaagtatgaattttaatagaaaaatgtgacctcattactgacattgtactgcagataatgttaaagtgaaagaaaaaataaggaaaaggggaaaaaggaggaaaaaggaaagcaagaaaagacaagtgaaaagattagtaatatattcattgtcattagttactgaaaatataacaaattgaattttaataatttttattaataaagtataaaattaaatgatgatagaaagtatatgcctcctataaatatcttccatttggtagcttttaatagtttcaaagccctttcacatatgttttaagtaagtcttttgagaaatacttgtgagttaatgggacttaaaccaacagaaaaggaaagctaatttagttataaatcaagcctgaggtttcagatttctggactaaaaatatggttcagtttgtgctgctgtgggatgaagaatgggcagagaaaatccacagtgcaggcatggggattaatggcatttggcacttagctgcagggtttgggggacaacagggagtggtgggatggtggttaagtaagggtgcatgccccacctgaagctctacagtggctcagctccaactgagtgttgccatgggaaaatctgatggggccagatctgatccttcagagaatgaggaattccaggttgttatgtgaattctcacaatttgtaaatgtcggcttgccattcagcttttttgtttgtttgttttaaataatatcatgtgggtcaaacaaactatgttaatggtagccatctggcctggggctagtagcttattgcctctggccagtggtgtgctaacaaaagtttaaccagcagctctccaacaaaaaagggaggtgggctgctctgcctatgcagtagccatgcttttattcctttactttgttaataaacttgctttcacttt

SEQ ID NO: 1693 - DNA, 823 bp, Homo sapiens
aactttccttatggtcatctttgggtggagccaccacttccagttctgatcttctcattctggttgagtacctgggcttgccagtgcaccccccaggaacaccgcctagtccagggctcccacaggtctcagactgacaggagactgggtcatatgaccagcactagccaatgagctgtgagtacacgtgacacagggacaagctgggtcatgtgactggcactagccaatgagctgtgaggacgtgagcacaggtccagctaggctgggtcatatgacaagcattagccaatgagctgtgaggacacgtgagtacaggtccagctaggctgggacatgtgactggcactggcccatgggctgtgagcacaggtcaggtcagccccttcctgctgcttcccaccgtgtgtgctccttgtctgacttgatatgagaactaacccaatatggcaggaagccactgacatgtgggagccgtgcatggcagtggccagcgtccttgtcctgcgggggctctgtggacatcactcgccttcagaacactgagccctcctacctcctgatatccagggctgccgatgggaaatcccaggctgccgcggctcctgtgtgctttgaagttttcaggatttttgtcaaacatccggggacccttagctggagaggatggcatgggtgacacgcagctggccagggtgcgcgactctgctctcaagaccccctggaggcccgccccctgccccccaccagctcattcgttagatgattggaagtgactgcctacgtcttctttcaggataaagcctcaagtcctgcaactatt

SEQ ID NO: 1694 - DNA, 5433 bp, Homo sapiens
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggaagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttgtaaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccagtgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcaattactgtgtatgcaaatataagtatcaggtacagagttgagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttataatgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttatgttgtttatatattttttaccttagtgtttacactggtaaggcttgttagtccatttttgtagtttttttaaagtaagcttttagatctatttgtgttttaatgtttcccagtttgggttttgttttgttttggaagaatctgctttcattattaaattataaaatgtaaatgctctaaagtaggaatttttaaagagtaaattatttgtgtagcttattaggaggttcaggttagtgaccataaagtgggttacttgtacatgaaaatttgaaatggtaccatgtaaaattcttctattgtcaactttttctgatgtatgccagttcatttactgacaaatgttgttactaagtgcttattaagaagtgtaatacgctataaaaaagttaatactttttgttcagatgtaaggcaaagataattgatgccgtttcagtgtatgattgtatttttaacttttacgttggtgggagtaactatttgaggaaatttgtggtgagaattagtaagagataaaacccccaacagtttattcttaccaagtaaagttttgtggtcatggggcagggaagagtttatttaccagaatactagagccctcacacaaaataaaggtaacttggaggagggctataatgcttgcatctcagtattttcatttcacttcatcctttcataattgccttgattatggtgcagtctaacctattaagcaacttctggctatggtaacattgatatgaaccatattatatcaagtctccaaaacatctagtttgttaacatacactttccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtgtgtgtaccttgtttctttcagacgcatctagaatgtttttctttcaccgtacctccaaaagaggcaatttagaaagtattaagtagtgacttttgttcagttccattttgtgtgtgtgtgtgtgtgtgtgtgtgtgtgtgtgaaccttgctttaaaacagtagcgtatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgttatctgcta

SEQ ID NO: 1695 - DNA, 1593 bp, Homo sapiens
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaa

SEQ ID NO: 1696 - DNA, 896 bp, Homo sapiens
cccggagcgatgggacgaggctctcccgcccgccgggctccaggatgccgcggctctcccagctccggcttgggcccctccggcggtgcccggccggtaccgtgaagccgccgctcggccttcggtgtagttgccccggacacggcgggacgccctccccgggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccagg

SEQ ID NO: 1697 - DNA, 1090 bp, Homo sapiens
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaataagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactcta

SEQ ID NO: 1698 - DNA, 3482 bp, Homo sapiens
agattcgagacctggaagggctggggcggcgcttggggcggcccagccgccgcctcccgttctctcctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaaatgcacagtgagtgtgaaggacatccaggcgcacctggctcagggccatgtggccatcgtgctggtgaactcgggggtgctgcactgtgacctgtgctccagccctgtcaagtactgctgcttcacccccagtggccaccactgcttctgccgcactcctgactaccagggccacttcatcgtgctgcgtggctacaaccgggccactggctgcatcttctacaacaacccagcctatgccgacccaggaatgtgcagcaccagcatcagtaactttgaggaggccagaaccagctatggcacagatgaggacatcctctttgtctacttggacagctgacagcaggagcctggtgcgcctaggccctcggaccccatccccaccccagccgggcccgctcaggatgccctggcccaggcttggggctgctggggttggaatgtggaactgcagcctcagcccatctggcagagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaagcccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttctttttcagagaaagggacttggccagtggtttaagtacctgccccttcacctctcagacgaggcagctgacgaggcagctggcccagtcttgggagtctgctcaggacagtggtggagctgggtcttgaaccccagtctgcacctaaaaaactaaaggaaatggatttttttttttttttttgagacggagactcactctgttgcccagactggagtgcagtggcacgatcttggcttactacaacctccgcctcctgggttcaagcgatcctcctgcctcagccccccactagctgggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaattgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagccattctcaataaacattattctcactgcaaaa

SEQ ID NO: 1699 - DNA, 773 bp, Homo sapiens
agtacgatagttccggcaccggaaaagagggctgatgactgggcccgggggccgccgcaacgacccttggggccggcaaagagccagagagggtgctcacacttccaagcaccccacaccaaggacaggctggacggcaaggcggagacgcggggcttgggccctcagaccggggacagcaggaggttgggccaagggccaggacttcccgtcacaatttcatttgttgatcccggcaccgccagccgccgcctcccgttctctcctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggggactttgtgcaactgcctgtgcccgtcatccagcagctctaccactgggactgtggcctggcctgctccaggatggtgctgcggtacctgggccagctggacgacagtgagtttgagagagccctgcagaagctgcagctgaccaggagcatctggaccatcgacctggcctacctgatgcaccactttggcgtgaggcaccgcttctgtacccagaccctgggtgtcgacaagggctacaagaaccagtccttctacaggaagcactttgacacagaagagacccgggtgaatcagctgtttgcacaagcaaaggcctgcaaggtgctggtggagaa

SEQ ID NO: 1700 - DNA, 712 bp, Homo sapiens
agcttggaagcttaggggagctgctgtggcccagggctcagtggggaggaagaggaggccaggagtcttggactagctgcagggtttgagctaggctgaagcagcagaaccacagaggtggctgagcaggggcctggccctgggacccagccatccacactcacacatccacttctccctccagagcccggccctgaagcaggtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcagtaaggtggcccaagagggagaggacatggcctccacccgctatgagtccctattggagaacctggatgaccattacccagagctggcaggtgcaaacagacaacaacccagcaggactcctcttgcagaatctggaattgctgagaagttgcatcagcaagaggggcaaggtcag

SEQ ID NO: 1701 - DNA, 646 bp, Homo sapiens
gtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcagtaaggtggcccaagagggagaggacatggcctccacccgctatgagtccctattggagaacctggatgaccattacccagagctggcaggtgcaaacagacaacaacccagcaggactcctcttgcagaatctggaattgctgagaagttgcatcagcaagaggggcaagggccctgattaaggggatggattgcacactgtagtgagacatccatcctgaccccacctcatcagccagggagctccctgaagacaggccatcgagagaggcacacaacaggctgtggtctaaaataaacttttaattgca

SEQ ID NO: 1702 - DNA, 829 bp, Homo sapiens
gggctcagtggggaggaagaggaggccaggagtcttggactagctgcagggtttgagctaggctgaagcagcagaaccacagaggtggctgagcaggggcctggccctgggacccagccatccacactcacacatccacttctccctccagagcccggccctgaagcaggtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcaagggagaggacatggcctccacccgctatgagtccctattggagaacctggatgaccattacccagagctggcagaggaactgcgcaggctgtcaggcctctcctctgtgggccacaactggaggaagcgtatgggcactcggcgaggccgccatgagcaaagccccacttcaaggcccagaaagggccctgattaaggggatggattgcacactgtagtgagacatccatcctgaccccacctcatcagccagggagctccctgaagacaggccatcgagagaggcacacaacaggctgtggtctaaaataaacttttaattgca

SEQ ID NO: 1703 - DNA, 1560 bp, Homo sapiens
agcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttagggtgaaatttcaattttggcatatcactcagtgggtactgttgtgaccatggctgtgttaacactccctcccgaggagacttccctgccacaggcgctggagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 1704 - DNA, 765 bp, Homo sapiens
aatcacttccgggaggcaggacagagcggggaaagtgcgcatgcgctgactgagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtcca

SEQ ID NO: 1705 - DNA, 1517 bp, Homo sapiens
agagcggggaaagtgcgcatgcgctgactggtgtgtgcgcgtttctatagtagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttaggagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggttcatta

SEQ ID NO: 1706 - DNA, 563 bp, Homo sapiens
atagtagcgagaggcgctagctgccagctccagcagcccagatcgcgcagtatttctgcgtggcaccgagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtg

SEQ ID NO: 1707 - DNA, 758 bp, Homo sapiens
tgcgtggcaccggtgcggatgcggctgtaaagcagtggtcaccgcctccgggagcccacttctatgtggagaggggagcacccagagagggtcttagggtgaaatttcaattttggcatatcactcagtgggtactgttgtgaccatggctgtgttaacactccctcccgaggagacttccctgccacaggcgctgggtcagaatgaggactgtgtgtgtgtatctgtgtgtctggatgggaggtttgggcactgtcgcaatattaactggcggcatcattctctggctcgatccccgcttccagacttctgggggtgttgggcgtcggggaacagagattagggacaggagacagggggtgtgtcattgcgtctttccctcctcagagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaa

SEQ ID NO: 1708 - DNA, 1784 bp, Homo sapiens
acacgcgtcctcccctcggcggggaggccggctaggggcaggcgggcagcgatgcctgcgtcggccacagctgcctggcactgccctcctttgtgcctgcctcctctgccagcctccgctccaacctccccccccaaccccgcaacgaggcctgctcctgggcccggccgcagggcccgttgcccacagagcgcccaccctgcgcccacccggggtgccctcaccttctgggcccctggctcctggcctcgggtcctgctggtgcccaggtcgcccggccccgtcctccgtgctccgcgtttgccccaccctgctgcccgagctcggcggcgagcctggcacggtgccaggctgcctgggagcccagcccgggcagggcgaactttccagcgagggttggtctcaaactcctgggctcatgcaatcttcctgcctcggcctcccaatgtgctggaattacaggtatgagctaccgcgctcagcccaaacccagggctcttaaccaccctactatgtactgtgctggcccccggtcaagggagagaactcacgtcaggcaaaaatgttttacagagaggcagctaagtcttttccacagtggatgacacagtccccctcacaaaccaccccacagatccaaccccaaggaactctgcttctacgtgtgcccttggggcaagggatgcaaagcaccaggcgatggagctcagaggatggcactcttccagagagctgtgtgtctctgggaaagctaacacacctctctgagcctgtcagcagatgcacaggcctgtgcacagagctctgcggagaccacgccgacatcgccgcacacccaccctcctgctcatgggacagaccattcacacctgcttcaccaccagccacaggcttgtcggaaggagcagactcttctccacggacaagccactgcccctttgagggcctcagcttccttaccctatgagatgaggaaacagatcttcacttgccacaggacttggggggatgaaaaggtaacctccgtaaagctgcccctggtgtggggaagccaccccatagatgacattgcccgccctccccctaggcccagagctctacagagtcctcaagctggtgtccctccaggctaaaacacttccaccccctgggcagtgcactacagggtggtggggaaggggccatctgtggaagaaacacagggcctggcctggggtcctgggcaagacctctgtgacctcagtttccccagatccctccaggtgtgaccttgtagatggcctctattctggattcacagctgctgaggaggaggaagaggacactgaaggcattccttcagtcccctggggaggttcagatgctcagactccctgataccacctttcctgggcagaataaagtccccaagatgtccaagccctaatccctggagcctgggaaagtgttacctcccagaccaaagggactttgtaggtgtgtgattgagttgaagatctgcagtgagagggtagcctggattagccacgtgtgcccaaaagcagagactccttcccagccgtggtcagagacagaacaaggggacgctgctggctttaaagacggaagaagggacgaggagccaaggagtgcaagtgccgccagaggccagaaaaggcaagggatggatttttcccctggagttccaggaggaaccagccctgccaacacctggattttagttctgggaccccacctcagacatctgacccccttgactgtaaggtaataaatgtgcgttgctt

SEQ ID NO: 1709 - DNA, 2817 bp, Homo sapiens
acacgcgtcctcccctcggcggggaggccggctaggggcaggcgggcagcgatgcctgcgtcggccacagctgcctggcactgccctcctttgtgcctgcctcctctgccagcctccgctccaacctccccccccaaccccgcaacgaggcctgctcctgggcccggccgcagggcccgttgcccacagagcgcccaccctgcgcccacccggggtgccctcaccttctgggcccctggctcctggcctcgggtcctgctggtgcccaggtcgcccggccccgtcctccgtgctccgcgtttgccccaccctgctgcccgagctcggcggcgagcctggcacggtgccaggctgcctgggagcccagcccgggcagggcgaactttccagcgagggttggtctcaaactcctgggctcatgcaatcttcctgcctcggcctcccaatgtgctggaattacaggtatgagctaccgcgctcagcccaaacccagggctcttaaccaccctactatgtactgtgctggcccccggtcaagggagagaactcacgtcaggcaaaaatgttttacagagaggcagctaagtcttttccacagtggatgacacagtccccctcacaaaccaccccacagatccaaccccaaggaactctgcttctacgtgtgcccttggggcaagggatgcaaagcaccaggcgatggagctcagaggatggcactcttccagagagctgtgtgtctctgggaaagctaacacacctctctgagcctgttgctacagctttaccatcagcgatgtgactgcaagccttctcagctgcctgtcagcagatgcacaggcctgtgcacagagctctgcggagaccacgccgacatcgccgcacacccaccctcctgctcatgggacagaccattcacacctgcttcaccaccagccacaggcttgtcggaaggagcagactcttctccacggacaagccactgcccctttgagggcctcagcttccttaccctatgagatgaggaaacagatcttcacttgccacaggacttggggggatgaaaaggtaacctccgtaaagctgcccctggtgtggggaagccaccccatagatgacattgcccgccctccccctaggcccagagctctacagagtcctcaagctggtgtccctccaggctaaaacacttccaccccctgggcagtgcactacagggtggtggggaaggggccatctgtggaagaaacacagggcctggcctggggtcctgggcaagacctctgtgacctcagtttccccagatccctccaggtgtgaccttgtagatggcctctattctggattcacagctgctgaggaggaggaagaggacactgaaggcattccttcagtcccctggggaggttcagatgctcagactccctgataccacctttcctgggcagaataaagtccccaagatgtccaagccctaatccctggagcctgggaaagtgttacctcccagaccaaagggactttgtaggtgtgtgattgagttgaagatctgcagtgagagggtagcctggattagccacgtgtgcccaaaagcagagactccttcccagccgtggtcagagacagaacaaggggacgctgctggctttaaagacggaagaagggacgaggagccaaggagtgcaagtgccgccagaggccagaaaaggcaagggatggatttttcccctggagttccaggaggaaccagccctgccaacacctggattttagttctgggaccccacctcagacatctgacccccttgactgtaaggtaataaatgtgcgttgcttaagccactgagtcagccataagttgttacatggctgccacaggaaactaacaggccctcccctctggccccaacatgcccagctgcctgtgaaggggaagaaggatggcacaaggcacggccctcatcgatgtgttcacacaccttgctcccctactgagctggccctggggctgcagacctgatccctgctctcaggagccttcgccagctgagagacgcccgcagagcctcccctccactgcggaggctcgaaccttccctcctgctgctgctgccccatcctctcctcttcctcctgctgctgtttgttgagtgctccctgtgagtaggcaccaggctagtgtcctcctcccaaccccagcctcataggctcagcggtcaggccacccgagcagtcacattgtagacccctgaatcctgcccatggtttggcaggacaaagggccttttctgcttcagagtcacaaatgtgtcctcctcacaataagggtggcatggaggtccctgggccagtgcctcagcctattgagcctggggtccttgtctgtacagggggatgaaggtagcacctcacagatggcgataaacccagccagtgcagggcaggcagtcagcgctccaaactcgcttcaagtctttgcctatgctgccaatcaagtcagctgtgggaagagtcaggtttttctcttgaaagtcagggccgggcacggtggctcatgcctgtaatcccagcactttgggaggctgaggtgggtagatcacaaggtcaggagaccgagaccatcctggctaacacagtgaaaccctgtctctactaaaaatacaaaaaattagccgggcatggtggcacgcacctgtagtcccacctacttgggaggctgaggcaggagaatcacttgaacctgggaggcagaggtttgcagtgaaccgagatcacgccactgcactccagccctggacgacagtgagactctatctc

SEQ ID NO: 1710 - DNA, 6619 bp, Homo sapiens
gttcccgactccggcaagagggtcagtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaaaaacaacaaaaaacaaaaaccttatttagaaaaatataaattgttgggattattttatggtaactatcactagaaaaggctctgggttcagatggttttatgtgtgagttatttcagggcacagataccttgtaggtaaaacaactggaaaccttggaaataggtgggaagctatttttagaaagcaggtatagccctggtagcaaagcaagtgagctggcagaagaaacccattttcagtcttgattctggtcagatgtgagaagtccctggatgtcctggcccagccccatgcttctgtgccaggtcacagctgccctccgtccgatgactcaggccccatccccccttttgtgggttgggtcagactgctccctgatgcctacctccagtgcactgtggcctggctcacctgtgggtctggcagtagaacccagagttgctctctaggatggacagcctagtcacccagctgacctttaccctgtcccacaggcttctggacaggccaccttccccatctccctttagtggacctgaagtggatactccagcctgggattgctgccttctcttttgaaccctgtcctattggggctttggggcttttgtgcccttgggacccaggcagctcctgggggtgtgtgagttatggtctgccgtgtgtctgagggccagtcatgcagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaa

SEQ ID NO: 1711 - DNA, 6785 bp, Homo sapiens
gatgtaatcggtctctggacgctgcgcggcgctcctaggagcaggcgttcccgactccggcaagagggtcagtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtccgcgccgggggtttgtgggggcacctggagacatttgggccgttctcgcagtctcgggaagccgcgcccgctccttgcctggcctcacggcggccgatctcgttctccactttctaggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaaaaacaacaaaaaacaaaaaccttatttagaaaaatataaattgttgggattattttatggtaactatcactagaaaaggctctgggttcagatggttttatgtgtgagttatttcagggcacagataccttgtaggtaaaacaactggaaaccttggaaataggtgggaagctatttttagaaagcaggtatagccctggtagcaaagcaagtgagctggcagaagaaacccattttcagtcttgattctggtcagatgtgagaagtccctggatgtcctggcccagccccatgcttctgtgccaggtcacagctgccctccgtccgatgactcaggccccatccccccttttgtgggttgggtcagactgctccctgatgcctacctccagtgcactgtggcctggctcacctgtgggtctggcagtagaacccagagttgctctctaggatggacagcctagtcacccagctgacctttaccctgtcccacaggcttctggacaggccaccttccccatctccctttagtggacctgaagtggatactccagcctgggattgctgccttctcttttgaaccctgtcctattggggctttggggcttttgtgcccttgggacccaggcagctcctgggggtgtgtgagttatggtctgccgtgtgtctgagggccagtcatgcagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaa

SEQ ID NO: 1712 - DNA, 6523 bp, Homo sapiens
gtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaaaaacaacaaaaaacaaaaaccttatttagaaaaatataaattgttgggattattttatggtaactatcactagaaaaggctctgggttcagatggttttatgtgtgagttatttcagggcacagataccttgtaggtaaaacaactggaaaccttggaaataggtgggaagctatttttagaaagcaggtatagccctggtagcaaagcaagtgagctggcagaagaaacccattttcagtcttgattctggtcagatgtgagaagtccctggatgtcctggcccagccccatgcttctgtgccaggtcacagctgccctccgtccgatgactcaggccccatccccccttttgtgggttgggtcagactgctccctgatgcctacctccagtgcactgtggcctggctcacctgtgggtctggcagtagaacccagagttgctctctaggatggacagcctagtcacccagctgacctttaccctgtcccacaggcttctggacaggccaccttccccatctccctttagtggacctgaagtggatactccagcctgggattgctgccttctcttttgaaccctgtcctattggggctttggggcttttgtgcccttgggacccaggcagctcctgggggtgtgtgagttatggtctgccgtgtgtctgagggccagtcatgcagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaagccactga

SEQ ID NO: 1713 - DNA, 995 bp, Homo sapiens
tatttcttccccttactaagctagcgaaaataaaatttaaggcaactgaaatatgcacccaatcaatgtgagacgagaccccagcatccctatctatggactccgacagtccatcttattaaataccaggcttcaggactgctatgtggactcaccggctctcaccaacatctggatggccagaacatgtgcaaagcagaacattaatgccccagcaccagctaccacttcctcttgggaagttgtaaggaacccattaattgccagttccttctccctggttaagcttgtactcaggcggcaactgaagaataagtgctgcccaccaccatgcaagtttggagaaggaaaactctcgaagagattaaagcacaaggacgattcagtgatgaaagccacccagcaggccaggaaaagaaacttcatcagttccaagagcaagcagccagcagggcataggaggcctgcaggaggcatcagagagagtaaagaaagttcaaaggagaaaaaactaacagtccgccaagatcttgaggacagatatgctgaacatgtggctgccacccaagcgctaccccaggacagtgggacagcagcctggaagggccgagtgttgcttcctgaaacccaaaagagacagcagttgtcggaggacacgctaaccatccatggtctccccacagagggttaccaggctctgtaccacgctgtggtggagccaatgctgtggaatccttcagggacccccaagaggtacagcctggagctgggcaaggccattaaacaaaagctctgggaggctctttgcagtcagggtgccatctctgaaggtgctcagagggaccggttccctggcaggaagcagccaggtgtccacgaggagcctgtactcaagaaatggcccaagttaaagagcaaaaaataggaacaagaactcatgggattagagtattctctgctagagatctgaaaaataaacacaactttgcaccttc

SEQ ID NO: 1714 - DNA, 978 bp, Homo sapiens
atctgcacttctgggcttcagcacacatcagtgtggttcacgtgtttcctgctgttatgaaagagattggagaggactaagcttggaattgcctgtcccacagcaagaggctatggagctgggccacggagcaggtacaaccactttcaccagggcccatctgaatgacaaggagggccaacaggacttggacccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtctt

SEQ ID NO: 1715 - DNA, 986 bp, Homo sapiens
gcacttctgggcttcagcacacatcagtgtggttcacgtgtttcctgctgttatgaaagagattggagaggactaagcttggaattgcctgtcccacagcaagaggctatggagctgggccacggagcagggcccatctgaatgacaaggagggccaacaggacttggacccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaa

SEQ ID NO: 1716 - DNA, 1149 bp, Homo sapiens
aaccatccattggtcttcaccagtagttctgcagtggggatctgcacttctgggcttcagcacacatcagtgtggttcacgtgtttcctgctgttatgaaagagattggagaggtgagaaactggaagtgagtccacacttccattgtagcccgtccagactgctgtggactggcagtgcactgggacgtacagagctgccgtgggcacgtcaggactaagcttggaattgcctgtcccacagcaagaggctatggagctgggccacggagcaggtacaaccactttcaccagggcccatctgaatgacaaggagggccaacaggacttggacccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaa

SEQ ID NO: 1717 - DNA, 1469 bp, Homo sapiens
cgtgtgcggtccctccccctcacgttctctcttcctctgctccgccatgatgagaagcgcctgcttccccttccccttccgccatgattgtgtttcctgagacctcccagccacgcttcctgtacagcctgcagaactacgctgtcagagatggattggggacaatcctgcggggaggtgctgaggagggcagctacgacaactggccccacaccaggaaaagctgggggccgctgagcccaggccaccaacgggagctgtggacccagcctgacccctggaccgaggtgctttcagggcacaagggggatgcgggagcctgtggctgctgttgcttctgctctcagttcataaacgcacgctgtgcacatcccctgtgcttggcaaggggcctggatagaagggccagtgaggagatgcccatcctccaggcactgtgcctcctcccaaaggaaaatctccatgatgccagcaggcgtgtccacagaggaaggggcgaagaaaatgtcgaatggacaggcgacctgcatcctgcccagctcggaagaggaggacgtcctgagatttgccacagcctggaggcgattgcgctcgtgacaaaagccagacacagaaagacaaataccacgttctaatttgtgcatgggagctaaaatagttgagttcatagaggcagagggtggggaagggctgggcaggggggaactggggagaggttggtcgaatggcaccaaggctcacttgggaggtgacaagcttgggacagcagggtggccgtggtgaaggagaacgtgttgggtacatggatttgctgtgacctgacctcaagtgctcttgccacagaacccaggtgctccctgctggaaagccacacgcggcagaggagagctggcaggaggaaaagcgggttcgagtcagcagcctttggagacggcagactgagagtgtcacagagaccatctcaagtctgcacgaattccaggctcttttatgttaagggcagggggacggggagggggttgggatcaagaggtgacaggtgaccgcacacatgtgggtgccagcgagggtccgaggaggctggcgatgccttcgtccttggtcaggtcacgagcacctgtgaatccacagcagaacagctgttcacagcttcccctttcatcccggagtgagtttcaaaacctgcatcacgactgcctctgtgtattttctccgtcctctagaagatcctaggctccgtgcaggaatgggtgaaggccccttacacaaaaacaaagtcaggtcctgagttcttttgctgtttctttgctttctcctgcaaagtcactcgaaaggtgactggcggaggtgaggctgcgctaattagcttgattgtggtgacccttccacaaagcacgtgtatgtcggcatattcactgggtcatgcacctcgaatacatatttttacttgtcaaatacatgataataaa

SEQ ID NO: 1718 - DNA, 2161 bp, Homo sapiens
cgtgtgcggtccctccccctcacgttctctcttcctctgctccgccatgatgagaagcgcctgcttccccttccccttccgccatgattgtgtttcctgagacctcccagccacgcttcctgtacagcctgcagaactgtgagtcaaccaaacttccttttaaaataaattacccagtctcagttaggtctttctagcagtgtgagaacggacacgtagagggtgtgagagccagaagactttaaggagagggacgagctggggcctggatgcccggggaggtggacctggaccaggacaggtgtcagcgggcagagatggggcagaggtgcggctgtctacccgcgaccggggccatgccctctcgggctcggttgaggagctgctcttcctccagaatgcgctcggacggaacgttaggaaggccctggtgagtggccccgacctcctcccccaggactggcttctccggccctctgccctttcgggcagaacagctcgtggctcttccaggacctggggctccatcttgcagaacagctcgtggctcttccaggacctggggctccatcttgcagaacagctcgtggctcttccaggacctggggctccatcttgctgaggggtgctttcttgagactccttagggacgattctgattttccctggagctgtacaatggcggtttatctttcaaggtcccctgggcctgggctccgaggcagccactttccctggagcccgtgaaggaggtttggacgccagctgggctgcctgcctgtggcggggcaggaatgagagctggtgcggctggggcccctgggtgcctggtcctgctctcatgacgcccaccccttgaaccctgacatgggcgcccaaggattctccccgcaggctcgcagactcacctgatcaccgggagatgtttgagaaggagcctgtgtcaaagtgtaggcatcagatgaaaatttaccttcttgttacctatgtaaatgggccgggctccacgaagtccttggctgagaacggtgccactgaccgactgagctcccgatcgttctgagagaggcttatgtgcacagtggacgtggaaggctttgatgatgttggtgaaactctctctgacgctgtcagagatggattggggacaatcctgcggggaggtgctgaggagggcagctacgacaactggccccacaccaggaaaagctgggggccgctgagcccaggccaccaacgggagctgtggacccagcctgacccctggaccgaggtgctttcagggcacaagggggatgcgggagcctgtggctgctgttgcttctgctctcagttcataaacgcacgctgtgcacatcccctgtgcttggcaaggggcctggatagaagggccagtgaggagatgcccatcctccaggcactgtgcctcctcccaaaggtcagcaccccgagcatcactgtgctctccccacaaaggtcagcagccccgagcatcactgtgccctcccctcaaaggtcagcggccccgagcatcactgtgccctccccacaaaggtcagcaccccgagcatcactgtgccctccccacaaaggtcagcaccccgagcatcactgtgccctccctcccaaaggtcagcacccggagcatcactgtgccctccccacaaaggtcagcaccccgagcatcactgtgccctccccacaaaggtcaccacagatgtccctgagctctgcagcacgtgggtccaatacagatgtggcaggtttgtctgttggggagtggcctggctggcagctgtggggagaaggccaggacggggcacagcagaggcctcacctgcccagcgggggctctggggctggggtggctcctcagagattgcccaagtccagagcttgcatcctatgcagccgtcacggggcacagggcccctgggttactggcaggtccgtcagccatagccactgccccatccagggcctgctggatttgcagaggccagacttgggaactgactgggggaggaccaggcccctctgcacccctcaggatttatgtgggggccggcctctgccgtccacctggggcgtgacaatgcatttgattcactgtctctctgtgtcactgtctctatgtctgtctttatctcactgtgtctag

SEQ ID NO: 1719 - DNA, 1756 bp, Homo sapiens
atatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggtagctgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccagcaatccctctgtgagagcgagcgggcacgagtccgggctgcacggaagcacatcctggtgtgggccccgaggcagagcccccctccagactggcatctccctctgccacaggagaaggacgagtgacaagcatccctgccattggcctgtgcagcttcctcagtctgtttcaagttgctgttgcacagccctggggactgtgaccagcctacacagtctggtgggtccctgtgagctcttgctcacaggaacatggagcaggacattgctagccctacttgcccacccctcacctgcatgcaggataccctgacactgcgatgttctgcaggacaattgcaccgctttagagcttccaggaggccaagcattatggcaggtacttgtgagcagccaggtcaggctgggcatggtagcataggagatggcggtcctgaggtctaggcttctcaggtaaactgaagggtagccctgacctgtgtggacacacaggtgggtcataatgaggtagctaaacagttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagctatttcatctgatttcaaatagaagctgaaaattaagttcacacttgttagattttgtgtgtaacagtgttgtacctggacagtattagaaatttgtatgcttattctcttgttaagtgttttaaaatgtatgaaccaccaaaaa

SEQ ID NO: 1720 - DNA, 1977 bp, Homo sapiens
atatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggtagctgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccagcaatccctctgtgagagcgagcgggcacgagtccgggctgcacggaagcacatcctggtgtgggccccgaggcagagcccccctccagactggcatctccctctgccacaggagaaggacgagtgacaagcatccctgccattggcctgtgcagcttcctcagtctgtttcaagttgctgttgcacagccctggggactgtgaccagcctacacagtctggtgggtccctgtgagctcttgctcacaggaacatggagcaggacattgctagccctacttgcccacccctcacctgcatgcaggataccctgacactgcgatgttctgcaggacaattgcaccgctttagagcttccaggaggccaagcattatggcaggtacttgtgagcagccaggtcaggctgggcatggtagcataggagatggcggtcctgaggtctaggcttctcaggtaaactgaagggtagccctgacctgtgtggacacacaggtgggtcataatgaggtagctaaacagttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagctatttcatctgatttcaaatagaagctgaaaattaagttcacacttgttagattttgtgtgtaacagtgttgtacctggacagtattagaaatttgtatgcttattctcttgttaagtgttttaaaatgtatgaaccaccaaaaacactatttcttgaagaggtctgtttattactaatagaatggtttctcatcctatggtggccctgttgtgtgatgctgagggctaggctgggtctgtgcccagcaccctccctgctctcttcctggacacaggcagcaagttgaatatcttttaatttgttctttggggcagaataatctatcacgttagaagggtgtccattaaagaacagtatttccctg

SEQ ID NO: 1721 - DNA, 1523 bp, Homo sapiens
atatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggtagctgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccaggtgctaagtgtggtggctcacacctgtaatctcagctacttgggaggctgaggcagaagaatcacttgaggataggagtttgaggttgcagtcagctatgatcgtgccactgcactccagcctgggcaacagagcaagaccccatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtggttcatacgagggagtcctgtggtgttgaaaaccatctgtcagcctgactggtggttacacagggctatacatgaagttaaaattgtgtagagttaggtacacaaaggagtacagatgtaactggggaaactgagtatgttctgtagactgtaccaatgtcaatttctgcgtcctgatgctgtgctgtagtgtataaggtgttaacattgggggaggctggggcaagggtacccaggacctccctagacaacctcctatgcaacctcctgtgaatctataattacttc

SEQ ID NO: 1722 - DNA, 1363 bp, Homo sapiens
gtagaaggaggaggagctccgactacattctgtccttgtgcctcttggacttttttgtgtgtttaggtgcccaatggggagcaaactgacttgctgcctgggccccagcgggggcctcaactgtgactgctgcaggccagatgtgggaccctgccatgagtgtgagattcctgagactgtggcagccacagcaccagcatccaccactgcaaagcctgccaaattggatttgaaagctaagaaggcccaactcatgcagtacctcagcctcccgaagacgccgaagatgctgaagatgtccaaaggtttggacgcccgctccaagcgctggttaaaaataatatggagacggcacgggatttggcctctagaaaatataggtcccactgaagatgtgcaggcgtctgcacacggcggtgtggaggagaatatgacatcagatattgaaatacctgaggccaagcacgaccaccgtcccactgaagatgtgcaggtgtctgcacacggcggtgtggaggagaatataacgtcagatattgaaatatctgaggccaagcacgaccaccatttggtcgaagatctcagtgaaagcctatctgtctgtcttgaagacttcatgacatcggatctcagtgaaagcctatctgtctctcttgaagacttcatgacatcaggtctcagtgaaagcctatctgtctctcttgaagacctcatgacaccggagatggcaaaggagagatatgaagattacctctgctgggttaagatggcacggtctcggctcaatgaacccatcagcagccaggttctaggacttctccggctttagtgttccaagtagctgggattacagacgcctgccatcacgcccagctcaaatcattttatgaatgcatatttccatctgggtgaaaaaaaaatcacaagcctctctctcttcctactgagcacctgtgaacagtgacctgcagtttgtggctgcagccagtcctcttgcagcctggtgttcttacatttcattctgaggctcacattctcagtcaccatgcagaagaacacccgccccatcctgggtcattacagagtgggtcaatccatctgctgcatctgaagagctgggtccagcttctacagtgaatccatatatttctgtatttcctggataaggaagagcaaaggagctgagctggtggaggaagaagaactaatattaactgactccttattttgtgctagtactgtgctagttacatattttatctcatgtaattcttaccaaactgtaagggggtttcggagtgatggagacaatattgatgttatctccattttagggtgagaaaataaaggctcagaaatgtta

SEQ ID NO: 1723 - DNA, 1300 bp, Homo sapiens
agtcagtagctcgcagtggagggaggaggagctccaactgtgctctttgatggcagtttttgcacctttgggtgcttgtcatgttcgtttatttttcaaagaagacagcaggtccctgacctcatagaccagctagtttgggaggtggcggcagaataagggctgaggacccagatctgcctggggtcaggctgcttctaaaagtgcagggccaccctcagtagtgtggctgctagggcagcacagttacaatttcgctgaaggctgaggcaggagtggagaggcatggagaggccccatggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagattttaccatcacctgtccagggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgttcttctgaggacaacctgagtttagtatgcctaccacgaagtgaagatgatgactgtgatgatgatgatgatgatgcccagattttaccgtcacctgtccaggcttgttctgaagatagcctgtttttaagatgctcactgagacacaaagatgaagaagaagaagatgatgatgacatccacataacagctcggatagaaagtgacttgacgctggagagtctaagtgatgaagagattcatccagggtgaagcccttctgtggagctgaccagggtgctgacccaaagggcaggccagcgcgtgctgcagggtccccagctttgcccctggaggtctcaatcctctctacattctgaggaaaactcttggtcccagcagagagaaaaagtccaaggctgcttcccacccaccgccagcactaggtttggcctgtaccatccaggacccagtgcttctgggcctggcatttctcctttggcaagagagtgagaagagacgtgactgtgctccacgagcagaaagtgccattcccacttgaaataaagagactgagtgcattta

SEQ ID NO: 1724 - DNA, 2553 bp, Homo sapiens
gggctggttccagcagcaaccgccgggcagggcccctcccgaccgcgacctcctgtccgcaccgtagggcagccggccgggccagcctccctcacaggactaccgaggaagaggtaggatttcactctgtcacccaggcgggagtgcagtggtgcgatcatagcggggactacaagtgtgcaccacatgcttgtctacgaacctgaagtattctgatgcagtggagagagtgtagaactctggagtgaagagatctgcctggaaccctgactctatcactaggagattccttggaatgaaaccaatgggagtccagggtttgggagagtctcatcagagcagatgggcgagcagcagccagaacgcttgttgcctttggctgagaacactatcctggatctgaatgtcttctttgtcactccaagagatggccctgggactgagaagtggatggcagctgtgacagcaggagaggactgcctgaggctccccgggcagaggctctggtgccaggttagcagcaggaccgacggcagacccagcagccagagagtgaaaggccaacttctcagcccccctggcctgctccatcccgtcaactctcccaggaactaccagcacccacctaagggacaccagccgccctgtgaaaggacaagccagagacccctggagctcggatgtggaaggatgtggggagctgcctggtcctgtctcccactgccgcagagggacatgagggatggagcaggactggcaacctggagaggaagtcactcctggtcctgagccctgttcaaagggccaggctcccctctaccccattgtccatgtgacagagctcaaacacacagaccccaactttccctccaactccaatgctgtcggcacctcaagtggctggaacaggattggcacgggctgcagccatacctgggactggaggttctcctgcacccagcaggcccttttgcccctactaggagcctgggaatggagcattgacacagaagcaggaggaggaaggagagagcagagccagaaaccctgcagcaacggagggcctgcagcagctggagagggccgagtcctcccaagcccctgctttccatggagcacttgccaggcagccattcacaaagtgtgtcgttggcagggatgcaccagaccagctctcctggcaccatccctggccacactcaaggaacacagttatccctgatgctcttggcctctctccctgagcagtactcaccagggcccacctgactcacgatagcccctgcccaacaggtacaagtggagctggtgctggccccgggctgcctcccacccaggtgcctggcctgtggctccaaggtggactcccaggcccagcaccaccagcagcagcaacagacccctctgcccaggccggcctcacacggggctaaagacacccacggctcctgccagcagggtccacacaggccacctcgctgcccgtcctctccctcagcccctccttaagcactcctgcaggctctcccagctgctgccagcacatcccgggtgaggcttgcccggacccacaggcaacctgggcccctgccaagccagaatccactctcagctgtgcctttctcggccctgagcaaagcagatcagtggagtcagaggcacctttggggcagacaggggaagaggagtgcattcattggggaaaggttgggagctacccagccgtaggctggcaaatcagctcctggccgggggcaccctgacttacaggctttgcctgatttctgtggtgtaaattctccccttgtgcccagtttcaagctactaatgtgtcgtggaccgtaactggggagcaacacagagtcagctggccacgatgccagtcactgctgagctgccaaaccttacgcgtcccagggggcacctgcctagaggccaggcactgcactggaccctcagacacagcttgtgcagcctgcttaggagcttgggaaatgactgtcatctgtgatcttgctggtcccaggaagcccattttacagatgaggaaactgaggcccaaaggcacgaagcgacctctctcagcctcaccaagagcactggaaggtggtgtagggctgcggccgtgcgcacagagagcacagcagcaggaaggctcctgggcctccagctcccctccctcagaagcctcccagagtgacaggaaggtcagaggccccggggagggggcggggccaggatctggcaatttcctatccctctctgttggctctgtgcatctaattactccttgagtcatctgttgctaaccaggaggggaaattaaatattaataatgtaatacttctctgtgattaccccttgttggggacagatcagagggcagatgctgccccatacagacaggggacacatgctgcggaatgtgcataatgcctcttgaaagaaccaccttataggattccacgcggtcagactcaaaactgctgctgcttcctgccttcctcctcacctcccccaacctggccactttaattaaaactccatttaatc

SEQ ID NO: 1725 - DNA, 2568 bp, Homo sapiens
tgcgggcccttgcgggggctggttccagcagcaaccgccgggcagggcccctcccgaccgcgacctcctgtccgcaccgtagggcagccggccgggccagcctccctcacaggactaccgaggaagaggtaggatttcactctgtcacccaggcgggagtgcagtggtgcgatcatagcggggactacaagtgtgcaccacatgcttgtctacgaacctgaagtattctgatgcagtggagagagtgtagaactctggagtgaagagatctgcctggaaccctgactctatcactaggagattccttggaatgaaaccaatgggagtccagggtttgggagagtctcatcagagcagatgggcgagcagcagccagaacgcttgttgcctttggctgagaacactatcctggatctgaatgtcttctttgtcactccaagagatggccctgggactgagaagtggatggcagctgtgacagcaggagaggactgcctgaggctccccgggcagaggctctggtgccaggttagcagcaggaccgacggcagacccagcagccagagagtgaaaggccaacttctcagcccccctggcctgctccatcccgtcaactctcccaggaactaccagcacccacctaagggacaccagccgccctgtgaaaggacaagccagagacccctggagctcggatgtggaaggatgtggggagctgcctggtcctgtctcccactgccgcagagggacatgagggatggagcaggactggcaacctggagaggaagtcactcctggtcctgagccctgttcaaagggccaggctcccctctaccccattgtccatgtgacagagctcaaacacacagaccccaactttccctccaactccaatgctgtcggcacctcaagtggctggaacaggattggcacgggctgcagccatacctgggactggaggttctcctgcacccagcaggcccttttgcccctactaggagcctgggaatggagcattgacacagaagcaggaggaggaaggagagagcagagccagaaaccctgcagcaacggagggcctgcagcagctggagagggccgagtcctcccaagcccctgctttccatggagcacttgccaggcagccattcacaaagtgtgtcgttggcagggatgcaccagaccagctctcctggcaccatccctggccacactcaaggaacacagttatccctgatgctcttggcctctctccctgagcagtactcaccagggcccacctgactcacgatagcccctgcccaacaggtacaagtggagctggtgctggccccgggctgcctcccacccaggtgcctggcctgtggctccaaggtggactcccaggcccagcaccaccagtgacagcaacagacccctctgcccaggccggcctcacacggggctaaagacacccacggctcctgccagcagggtccacacaggccacctcgctgcccgtcctctccctcagcccctccttaagcactcctgcaggctctcccagctgctgccagcacatcccgggtgaggcttgcccggacccacaggcaacctgggcccctgccaagccagaatccactctcagctgtgcctttctcggccctgagcaaagcagatcagtggagtcagaggcacctttggggcagacaggggaagaggagtgcattcattggggaaaggttgggagctacccagccgtaggctggcaaatcagctcctggccgggggcaccctgacttacaggctttgcctgatttctgtggtgtaaattctccccttgtgcccagtttcaagctactaatgtgtcgtggaccgtaactggggagcaacacagagtcagctggccacgatgccagtcactgctgagctgccaaaccttacgcgtcccagggggcacctgcctagaggccaggcactgcactggaccctcagacacagcttgtgcagcctgcttaggagcttgggaaatgactgtcatctgtgatcttgctggtcccaggaagcccattttacagatgaggaaactgaggcccaaaggcacgaagcgacctctctcagcctcaccaagagcactggaaggtggtgtagggctgcggccgtgcgcacagagagcacagcagcaggaaggctcctgggcctccagctcccctccctcagaagcctcccagagtgacaggaaggtcagaggccccggggagggggcggggccaggatctggcaatttcctatccctctctgttggctctgtgcatctaattactccttgagtcatctgttgctaaccaggaggggaaattaaatattaataatgtaatacttctctgtgattaccccttgttggggacagatcagagggcagatgctgccccatacagacaggggacacatgctgcggaatgtgcataatgcctcttgaaagaaccaccttataggattccacgcggtcagactcaaaactgctgctgcttcctgccttcctcctcacctcccccaacctggccactttaattaaaactccatttaatc

SEQ ID NO: 1726 - DNA, 690 bp, Homo sapiens
ggtgccttcccggaagggctcagaggcgggctcgctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaa

SEQ ID NO: 1727 - DNA, 631 bp, Homo sapiens
gtgaccacgccctggcctgcgctaaggccccggcgtcggcgcagtagctggtgccttcccggaagggctcagaggcgggctcgggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataa

SEQ ID NO: 1728 - DNA, 465 bp, Homo sapiens
cggaagggctcagaggcgggctcgtgctgatagtgggcctcacagaaaagttaccatgaaccgactttccgggattcccttggcgctgcattaattggcctcgttgcaaaaggaaaccgagaggaaggcggcaagacttggcctgcgggtgatggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagc

SEQ ID NO: 1729 - DNA, 3525 bp, Homo sapiens
agaggcgggctcggtgagtggagtcggacagtgggtgggtgccctgactgcctgacggccgcgcagggccttgcaggaccgctggggaggatgttgttaacgtaaagagccaggctgatgaggaaggttcatgagtcctttgggtataagcgggagttggggcggccggagggcagatgactctgagaagggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatggttcttttttttttttaaaccattattgtttcttttaacaaattaaaagacaatgacacctaaactgctctagcaaaataacttatgagaaaataaattcataggattttgtccctcacagatagccaaagctctgcaagttctggagacagaaagaactgaactataaagcagtcaataagtagccagtttcaggaagactcagacttggttttgaaaaaggatgccttttagagctgggaaaggttattggattttgacttggttatttaaagattgccaaccttgtgaatgcaaataaccccactcttgtcttttcatctttaaacttccccttcccgcttccttctaatttcattattcctgaaaaaactgtcagtcagaaagcgttgggtcacaaccctaaacagctttgagattcctcagtccaccactgcttgagcacttaaaaaaaaaaaagaaaaaaaaaatatgtatatataactttccagctatagaggcagcctctgctagtaaagggtacctatgctatattacaatgaaatgttttaaatttcaaactggtttatgtttttaaaagaagacaataggaaaagctaaatacacagcaacaacaacaactatattgaaacgtccgttgtgccgataagttcctttaaactaccatcttggaaatatcctgttgagtgggtgttggtgtgggtaacaataatgttgttttcataatatgtgctggcagattagcacacttctctacagtgttaacagttgtaattaaggaataaacagcacagggtgtcagtccgatgacaatttcatctatagtgtcacaatacaaaatgtcacaaaatattagaactgttatataactataaaaagtatcagcttaaaagctaaaagcctttgaaaaaagaagacagaggaaggaagaaaaaagaaaactggcatagcaaccagaacaattttataccttctcaagaatgttctgtcatgaaaataaattgataatttttttctgttacattacagtttggtttctagccatccagttgatttagcaggagaatgcaggtttttttagcagctttgaattggtaaacagatttagatgtagtagaaaggaacatgaggaagttgtttttttttttaacatccaatctttcccagcatatgcacataagaaggtgaatgaagcaatgtgaaacttacttctctttagtcaagtgaaaaaaaggctaaacatttgttagatggtaaaatattgtgtcaagcgagtaggcaaattccaaaattacacagtggttgatacattaacatcctcaaatatttgagcatgcacttcctttgagatctgtaaattaaatcaccagtgggttagataaaaatacaaaacaaatggcaatctaaccatctcagaaaaggttcaggtttttttctccctaaaactgagaacttgctaaataatttttgaaaagcataaacgtaatacaccctgggttacgatcgagggcagaagggaaggcatttccaaggctcctgctgtagtgtttttcccatttttgttaatacctcaaaaactcccagagatgactttattcctggcccctgcagagctcccctccccacccccaccttgtagactgtaacagattgcaccacatggtgtctgtttaaaaaaaaaaaaaaaattcccatagggacctggatatcccattaatgggctttatgttcctcatggcaaattagctttacacaggaatttccaaacattgttttctgttaagaagggaggaataccatatataatgtatattttttctacaattagtaggaatcagacaaggaaaaggaaatgtcatctattcatacctttctctccaaattcagtgttctttccatatgctccattgtactccaccactcttctccatgaaaactatgaatttatggtttttttttagaaaaatggagttttcaaaatgaaagtcaaataattttttccaaagccgtttgtggactgttgcaaatgcataaatattcaaagctcattttctgcagaaacacttctggtatatgaaattattaaactgtagaatgctaaagatcagaagaagctacagtttttctttaaacttgaaaaaaaattaagaagtattaaggaaaaagcttaatactctggaaaccagacatctggtctttctcatgcgtagggagcagtgtgaatgaaagtgaagtcaaacggacagtttttttctgcattatgcacaaggtgttttaaattgtcagcttaaggtttagatgaagataatctttaactttgtttacaatttttgctattttgcattatccccctttttccataaaaaataaagtgaatatgtgtgcatatttattttgaatcaaaattaaacttattttgagatta

SEQ ID NO: 1730 - DNA, 765 bp, Homo sapiens
ggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaatt

SEQ ID NO: 1731 - DNA, 1576 bp, Homo sapiens
gaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaagggacgacgatgaggaaaaccttcctgagggagagatccctcctccccaagaccccagtgaagaatgggtggattacgtggactctttggggcgttcccggcctgtatgagaaagatttgccagatctgctggagatggataaaaatcttcaggggagactttttattagtctgctaatgaaaaccctattatctgaagatatgagaaaagaacttcagcgccagcaatgggaggaagaagaaagagaggccctgaagaggcccatggggcccgtacattatgaagacattcgggaaaatgatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgc

SEQ ID NO: 1732 - DNA, 2942 bp, Homo sapiens
gacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgaggcccggcaacttggtgttgggtattttgcctttgcccgagacaaagagttgagaaacaagcagatgaaaaccttagagatgctgcgtgaacagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccgtgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccaactaa

SEQ ID NO: 1733 - DNA, 1000 bp, Homo sapiens
aagggcttctgaccttgcagtgagcttgttggcactgcctgtccggggaccctggggctgctgttcctgtggtaatgtggcagctgggaccatggccagcttcagtctgcctggcgtcacataagccagcccacagggtcctgcagcttgtcctttctggctggaagctctgggcatagcctgggactgggtctttccagagagggctgtagccagggccctgccagcctcgggggccacagcggctctcacaccagcatcttgctggataggagcagttccaggactctctgatcacacctgatcatcgtcactgccagaattcaaggtagctgcctgccatggctgagaggtgtgcctcagcttaacccactcagtgatggactccagtgcctgcaagaagtctcaccagagtaagaagtggaggatccaggcccaggagaattttgccaagaagtttccgtacaggttgtcgtggctgacagagcccgaccctgagcccctgcagccctgggaggtcacaaacgactcgaacacggtgcagctgcccctgcagaagaggttggtgccaacgaggtccatcccagtccgagggctcggggctccagattttacatcaccgtctggctcctgcccggcaccactaccagcaccatcaccacctccactgtgcaacctttgggaactcaagttgctgagtcgccgcttccccagacaactcgccttcctgctgtccacccggcacactgaggctgcctgcccccagaccagcaaggcggcagggctgtccaggggcctctcctagagactgggctctgtgtgtggccttcttattggccaccttctccttggcaggctctgggcagtagccacagagactttagtaaagggatcagccttcatggccatcatagaccgggagtggtttgtggtccccccaaaaagctacaccaagctaataaactgcgagttcccaccccacttccagctggaatgatca

SEQ ID NO: 1734 - DNA, 1055 bp, Homo sapiens
gtgggactgggcccaggttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccaggactgtcaatggcaggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggagtgagtcccaagttaccctgccacacatcagagttgcgcacgatgaacaacaaaggactggtcaggaagccccagcccatccgcctcagtggagtagattctgtctttggcagggttatcacagctcagccaccaaagtggaccgggactttcagagtttcagacaagtcagccttttgcaaaatcattagcagggagcaccagtggcccattggactgaaggagcctcagattcagatgacagtcactatgtgcaaacagatgctgcgctctatcctcttgctgtatgcaacttacaaaaagtgcacctttgccttgcagcactccaagtaaagggtcctcatttgatccccatttactcacaccatgccctttggtatgtacctaaagcttacagaaacctgtccatgtaaatgaaactgtgacattgtcccagccatcttgcttttgtttcaagcagtgatgattcaggagcccctttcatcccttcccctccaaaaaaggaccaatgatagagaacaaggaagaacattcccattgtaaggttgaaccatttagagtcaaactagcattgacatgtccatgtgataaccgttaaacaaatgatataaaccaatgagcctagtgtgaactcaca

SEQ ID NO: 1735 - DNA, 1014 bp, Homo sapiens
cccggatggtgggactgggcccaggttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccaggactgtcaatggcaggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggagtgagtcccaagttaccctgccacacatcagagttgcgcacgatgaacaacaaaggactggtcaggaagccccagcccatccgcctcagtggagtagattctgtctttggcagggttatcacagctcagccaccaaagtggaccgggactttcagagtttcagacaagtcagccttttgcaaaatcattagcagggagcaccagtggcccattggactgaaggagcctcagattcagatgacagtcactatgtgcaaacagatgctgcgctctatcctcttgctgtatgcaacttacaaaaagtgcacctttgccttgcagcactccaagtaaagggtcctcatttgatccccatttactcacaccatgccctttgtgccttggtgactgtcaaataaaagcaagtatatactcagttctctccacacttcccacatacttaccaagcaaaaagcccatgaaaaatctgcagcagcctctgatagcaggaagacattatgtggtactcctgaactttcactcctggtccatcaactacaccgtgattctcagcagctaaacactaaaaataaaaatgattttaggaca

SEQ ID NO: 1736 - DNA, 2153 bp, Homo sapiens
gtccgtagccacggcaacaggttgcttctgcagtctgagctgagcgcctttcgcacgacttggagttacggtttatctgataccccggtacccctacgcaagcaagcccacatcgacacacattcacacacgcccttcagcaccccctcccagcaccacgaccatggacgacgactatgaagcgtaccacagtctgttcttgtcgctgctcggactctgcccgtctaagactcccatcaatgaaaatgctcccgtctttgatcctgaaccggtcattgcccactgcttcaagcagttccagcagaaggacttccgcctgcctcagacccgccggcgaatcatcatggtgcctcgcaaggaggatcagacaccccttaatcctgcatcccaacctcaggctcccccaaagcccatccccagcttcaaagttctggaagctagagatatccaagagcagccagaggacaggaagacctggctgagccagaggtcgaagctgcggcaggagctagagtcctttggtgatgtaaagaggtggctggagaacaagcccagcatcacgccttcagaggccaaggtcttacacatgatccacgaggagcagagtgcccagccaaatgcctcccaggcaactaccaggaccaccaggaagaaagcccccaggctctcccggctgtcccgccagatggtgccccagctccagctgcccgagccccctgccctgtcggtcatgtactcctacctgcatagccgcaagatcaagatcctggagatatttcacaaggtgggccagggtgagaaccagagaatcaccagggaggagttcatcgcggctgtaaaggcagtcggagtccctctgaagaaccaagaggtggaggatatagtgatctacctcagctctcttgggaagcacaacaccatcaccatggatatcctggccaatacctacaagcagtggtctatggctcagcaaaggagcagcctggccactgcaagggagcattatatcttggccaagcacagagattccctgaagggtccgctcaagaagcaggaggtggattcagccccacagcttcccaaagtggacctactgacggtgcctgcagtcgacacgcagatggagacgcggcccatgaccctggaggagatggaggaagtgggcaagcggtaccgcgagcggcagcgacagcacaagctcacgatcccctccatccagtacacggagcaatgtcacctggtgcgctgtgggaatcggcactttgatgagcactgcctcccgtccaccatccacggggatatgagggagctcattgactcggcccgcaggcacaactttctggtctacctgcaatgctggaagctctgtaagtcctatggcctcccgctgacagaggacatcctcatgaaagccttgctgtacccaggagacaagatcattttccagatggacaaagtgtgccccatccggcagccgggaggctactactctgactggaaggtcttttctccgaatctggctctgctccggtcccagggccctggcaagtctaagaggactgacaagaaaacgccaaagaaaagcaagaaaatgcgctttaaggagtttgaggaatttaccaggaagctgaaggtgaagaggtccagtggtctgcagcaaacacaccccaattccttctggccgggtcatcttctggataagctgcagctctacctgcccactgtggccacagaccggagcctggcgctcttcagttgtgttcaacaccagccccatgtctacccagccacctaccaccctgaccactggtggccccttaggaacaagaactacatgacccacgcccattatgatgccgccaaggtgtactacatcaactagagctagccaggtgttgccggacccagccttcctgggccaggggccagtgcagccagcggcccagagcccagacacaagaggagtgtcaaagagtcaaactaaagaaatcctttcaaagagggatggaccgggggccagttccctctggactcaaagtgtccagtgtctcagagggtagatgtgtccaaggaatgacgtgcagtttttgactatttccctcccctgacctctgccctttctacataaagcaggttggagtttttctcatttc

SEQ ID NO: 1737 - DNA, 2154 bp, Homo sapiens
gtccgtagccacggcaacaggttgcttctgcagtctgagctgagcgcctttcgcacgacttggagttacggtttatctgataccccggtacccctacgcaagcaagcccacatcgacacacattcacacacgcccttcagcaccccctcccagcaccacgaccatggacgacgactatgaagcgtaccacagtctgttcttgtcgctgctcggactctgcccgtctaagactcccatcaatgaaaatgctcccgtctttgatcctgaaccggtcattgcccactgcttcaagcagttccagcagaaggacttccgcctgcctcagacccgccggcgaatcatcatggtgcctcgcaaggaggatcagacaccccttaatcctgcatcccaacctcaggctcccccaaagcccatccccagcttcaaagttctggaagctagagatatccaagagcagccagaggacaggaagacctggctgagccagaggtcgaagctgcggcaggagctagagtcctttggtgatgtaaagaggtggctggagaacaagcccagcatcacgccttcagaggccaaggtcttacacatgatccacgaggagcagagtgcccagccaaatgcctcccaggcaactaccaggaccaccaggaagaaagcccccaggctctcccggctgtcccgccagatggtgccccagctccagctgcccgagccccctgccctgtcggtcatgtactcctacctgcatagccgcaagatcaagatcctggagatatttcacaaggtgggccagggtgagaaccagagaatcaccagggaggagttcatcgcggctgtaaaggcagtcggagtccctctgaagaaccaagaggtggaggatatagtgatctacctcagctctcttgggaagcacaacaccatcaccatggatatcctggccaatacctacaagcagtggtctatggctcagcaaaggagcagcctggccactgcaagggagcattatatcttggccaagcacagagattccctgaagggtccgctcaagaagcaggaggtggattcagccccacagcttcccaaagtggacctactgacggtgcctgcagtcgacacgcagatggagacgcggcccatgaccctggaggagatggaggaagtgggcaagcggtaccgcgagcggcagcgacagcacaagctcacgatcccctccatccagtacacggagcaatgtcacctggtgcgctgtgggaatcggcactttgatgagcactgcctcccgtccaccatccacggggatatgagggagctcattgactcggcccgcaggcacaactttctggtctacctgcaatgctggaagctctgtaagtcctatggcctcccgctgacagaggacatcctcatgaaagccttgctgtacccaggagacaagatcattttccagatggacaaagtgtgccccatccggcagccgggaggctactactctgactggaaggtcttttctccgaatctggctctgctccggtcccagggccctggcaagtctaagaggactgacaagaaaacgccaaagaaaagcaagaaaatgcgctttaaggagtttgaggaatttaccaggaagctgaaggtgaagaggtccagtggtctgcagcaaacacaccccaattccttctggccgggtcatcttctggataagctgcagctctacctgcccactgtggccacagaccggagcctggcgctcttcagttgtgttcaacaccagccccatgtctacccagccacctaccaccctgaccactggtggccccttaggaacaagaactacatgacccacgcccattatgatgccgccaaggtgtactacatcaactagagctagccaggtgttgccggacccagccttcctgggccaggggccagtgcagccagcggcccagagcccagacacaagaggagtgtcaaagagtcaaactaaagaaatcctttcaaagagggatggaccgggggccagttccctctggactcaaagtgtccagtgtctcagagggtagatgtgtccaaggaatgacgtgcagtttttgactatttccctcccctgacctctgccctttctacataaagcaggttggagtttttctcatttca

SEQ ID NO: 1738 - DNA, 1201 bp, Homo sapiens
gacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 1739 - DNA, 2697 bp, Homo sapiens
agcaattgggaacagaaagtgcttcctgtcccggcctgagacaatggacaataaacccagcctgctgggccccggcccctgaccccaaggcttcaggaagaggctcccacacgcacacacctgcggtgtgtgaagctcgcattgttctgggctcatggccgagtagggccccttgctctcaggagcctccagctctttctggacctgagccctgggagccttcactctgcccagatgtgcttcctgtggaaggagacccccagatgacacagatggagtcttgctctgtcacccaggctggaatgcagtggcatgatcttggctcactgaaacctctgcctcccggttcaagcaattctcctgcctcagcctcctgagtagctgggattacagaaaatctgagcagtgggtgaggccgagggactgcccagagccccagagcacggcagtgggcaagcagtcgtccctgtcctgggcatccctgtggccatggagctcctgggtgagcagctgctctgagacaagtctggtgaagaatacagcaggactcctgaacattcttccttaaatgcttatctgtggaaaccagaactgcccttggcgcgtggctcgtggacgtgctgggtggctgggtggggcgggtgcacgggtggagcctcagctctgtttctttctctgggtagtgtccccactgctgggcttctcccgctctcagctctctggggaggtcccctgtgaagggcctgtctttcctgtcccctccctcggatcattaatgaaccactctctctctctttttccttttcagtgattgggctgtcggaatcaaagaggccctccggtgactcaggcgtttcccattgccctattctagcatcctctactcttagcactgagagtttttcacgtcctatttggaactgataggaaaccctttcattgtttcgctacatggatattagcactgatgaaggaagcgctccatcagatagtggtccgctgcagtgagctggtttccagcacgagcctgcctagactcagcgtctcccgcctccagggacccccagactctcagcccctaggcaccctgggccagggtggttggaagcttctaggcattgtggggtctctggcaccagagacactcgggggtctggggaccgagtttgggccctgtacccacccactaccatttgacatggtgagagagagagagagagatgacgagctcaggcagggatggcttctccagtgcccacaatgtgccaggactctgctgtgccactgtgggcctttcctcacccctccctcccagacatcaagctctggtttccagctgtgttccttgaagccgtcgggctctctggtgacagccacagagcctctgagcaactttgctttcagctattttccatgacccagtcctgggtaaggcttcatttgaatgaagggttctgctgctaaaaaaaaaaaaaaagtcggaaaaaccacctgatcacaactttctaaggcagctattttgttttgcaatgagatatttgcagtggtttcactaaagcctgatcttcccactggactgtcggcctgtgaggatgaggacgtgtctatcacagtcagtatgccctgaatgaatgggtgtcaccctcctccccctagtgagagataaggacctcaggctcagagaggttatgtggttttctcaaagccacacagcaagatttggcaggtgagccttacttctcttcctgggctagcctgcggtcaggggcaaggcttttggatgataagagtgaggtgcagtcagctctagattgggggtggcagagggaaaaggagggggggttcccaaagcaccattctgctttctgtgagaagggatttcccctcaacaacttctgtcccatttttcagagctaaagtgacaagccacatccacgtccctggttaaaggtgctccccctgcaggaaacacatgtgcacttgggatggagccctctgtgcgggagcggcttgctcacctctcagccagtgccagctgggtgggtctctcccagctctcgaatcctaactgcagccaccatttattcagcacctgttatgcaccaggcactttatgtatcttattgctaaccctcaaaacaagcccttcccaacataagcgcttttgtgccaaacccataggtctgaaactgagacccagagaggctgaatgacatgctcacagtcacacagcaggcagtggcaggcagtagtgaagtcggctctatggattgtatacctgggctcctccaggcctctgcgctgcccggcctgataccctagcaggttgggtattcagaggtgcctggggagcttgttaaaagtgtagattccaggcctccttacccttagagactgtgactcagtatccggggcagggcccaggcatcttcattttgacaggccgtcccggtggctgccatgcgcaggcaggttttaggaacatcatgggtggatgattcctggtctccccagccctcttgacctggccacagagagctgcctttccagcgaggtcagccgagatgacgctgccgggagagcagtcttctctgtagtccccggaggggactcctcggaggaaggatgagtctgagggttccggttgtcttggcctgagaccacccaaggtcttttaacagaaaaaaactttaccca

SEQ ID NO: 1740 - DNA, 1814 bp, Homo sapiens
agtgcctggcaacctagaccagtcagggacgcggcaggaaatggaagagcctccgcaagaggctctggctgaacccttgaaacatgaaagcccagccgctccctcaagtgctggccacactaagggccaggaagaagacgaccagaagaaccaggccgaaaggaaggcagataaccacactgctcacagaatagctgaccagactgccctaagagtgcctagccaggctgaatccagcatatttagccaagctaccaacggagtagctgaacaaaatgggcatagtacacctggtcaggctggccgcagagcatccaaccctgctgatgtttctgaccttagagcagatgatcaggttaatcaaacaccgtctgaacagactaaaggcaaggcatctagccaagctaataatgtacagcatgaacagagtgatggtcaggtgtctggcctgacggaggaaagaactgctgaacagactgaacgaagattacctacccaggctgagagaagaacttctgggcagattgatggtagactggctatgccatctgaccagagaggttccagacagaccgaccacagaatggcaggccagtctgagagaagagcttccgagcagatggaccgcagaatgtctggcgaggctgagcgaagaacttctgagcagattacacacagattatccaaactatctgagagaagaccttctgtgcagattgacagtgggtcatccgtcccatctgaccaaagtccttctgtacagattgacagtggatcgtccgtaccatctgaccaaagaccttccgtacagattgaccgcagaatgtcagggaaagttaggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatctcatccaaattgaactataccagcagtcaagaaaaaactcaagccatagtaaccaaatctgatgaattttcagaaattgaccaaggaaagggttatcatatacgcaatcaaacttatagaaggttcccttctatagtttatgaagatccttaccaagtttcactccaatacatggaaaaacaccacattctgcaaatattccagcagattactgaaaacttagtctatgaaaagccagaggaccccctgaattttatgctgtgccaggtatagaattggagaaaaagaacaacctttttattctctttattgtaaaatacagcacacatacagcaaagtgtatagaacaaagtacgtacaactctgaattcttatgaagtaaacatacctgtaactaccattcaagtttttaaaaaataaataaaacataaccagc

SEQ ID NO: 1741 - DNA, 2561 bp, Homo sapiens
ctcctaagaattctctcacctgccttctgcccttaggctctgctagattgcaaatgacctgctttctttctgatcctgggctgcgttcccacccctgtcagatagtaaatcccaagtaaggtacctgctttcggcagctctgagctttcttcttggacacctaaaacccacagtcctccaggctccgatagattgcaaatgacctgctttctttctgatcctgggctgcgttcagacccctgtgggatagtaaatcccaagtaaggtacttgccttccgcagatctgagctttcttcttagacacctaatacccacagtcctccaggctccgatagattgcaaatgacctgctttctttctgatcccgggctgctgagttcggacccctgttggatagtaaatcccaagtaaggtacctgccttcggcagctctgagatttcttcttggacacctaatacccacagtcctccaggggcaagaggatgctattactgcaaagagtacagaggatgtacacccgtctataatatagttggtgatttccagaggctgagaagatattactgacaatcccgtcaacatgctgtgtgaccaccgtggattgtaatatccaggaaaacgttactgctaatgtcacaggacgtgtagaccctgccatcaaattcgtaatatcctagcgggacttcactagtcatttcacaatgcgtgtgcaccctttgatattattcgtattgtcctgaagagatgttactactgatgtcccaatgcagttacctgtgtgtcccctgtggtacctatggaaaccagttgttgggaaatccttgttaagaaaatgggccttgtaatagtacctcttagggctgctgtgaaggaaggataacatggaagcaacatgcctatcatagtgctttgtgtatgcccctgtcaaccatcactctactttgtgtgtgtgagtttgaccacctgaatctttttggcaccatctcaagtataattcaaatcacgaggcatttgtgcatatcgacaatacacccatcgtggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttg

SEQ ID NO: 1742 - DNA, 1799 bp, Homo sapiens
atgcgggacacgctgtagaacagctcacactggctggcactgctaagcaggtgcggaggggagtcagagacccccggatggaggggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaagtgcaa

SEQ ID NO: 1743 - DNA, 1645 bp, Homo sapiens
ataacatggaagcaacatgcctatcatagtgctttgtgtatggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcaggtgagccagggcggaggggccatctggctctgacgtctcttcctgggctgctgagccctctttcctgagaacgtcggagcggaaggatgaggacgtagagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataattta

SEQ ID NO: 1744 - DNA, 1182 bp, Homo sapiens
actcgaagggcagacatctctttggcaggacgtctggaacatggacagggatctgaatgaagatgacagtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgt

SEQ ID NO: 1745 - DNA, 1665 bp, Homo sapiens
tgatggatggggcaggggaagaaagtcctggaagatcccgcactgctaagcaatgctttgtcccaaagtaacgctcttcactctgctcccagcctagctgccgcaagagcggaacagaatattctgtgtgctcaggagaagaaaagagcagatatggttgagcactaaaaccctctactgtgggtagtgaacctaggtggacacagttgctcaccgggacacttaaaccagctttgcggggctgtcggggttgggaagcacagtctggaaagatttcccaatggaggaagcaccaattgtgggtccctgaagctgaggggatgatgcccaggcaaggccgaggcagtctgcagagggctggggaggtgggaaagacgattttgctcagaggaggcagagatggggtggtggctgagagagatgcagggtcaaggaaaggatggcttcagagaggagagatttgctggggcaaaaggccacaggatggggaggctgcggggtccaagaggacagctgatggagcgagaccctgcaggcaaggaggagatggggtgactcatggcagaatcgcaccagagttcccacagccctgtgcggccactatgactagtcccatcctgtacatggagaaaacgaggctccttccagttgtccctcacgcctcccttgatttatgtactacctgatgtgtataaggacaggtggtgacaaacacatggtccctacccttcaaggacatataatccagagctaagacaagaccttaacacagggcaaagtactatgctctgagttcatttgatgagcgatgggagaacgggcttgatcctagccatgcgggagagactggaattcaagagagtcaaatgtgctgggaaagactttctgggcaaaaggaataagcaaaggtgtgcaaaggtaaggaagcaggaaacctttgcacatcttgagaactcgccggccagaggcctgtgaaggagcgcagtggtcaggcaggagaggcagtcggatgcaggctgagaccatcctggagggtcttgaggctggcttaccccaggctgtgagtagtgggctcagcctagtcccggctcctgggttagtgctcacgtgtctctctgccccctcagggcctggaggaatggccttagagcccccaccaaccacgctcaggaaggcattcctagctcagagtaccctcctggagtctacactggaaggggctcctgagtgggccgcgccacaccccgaggagcagaggcgcagtcctcccgcgtgctcccagcacactccacccctacccagcacacccacggggcccccaccttgctcacctggggggaaccacccactctgcgccctctcagggagaggtggtggccgctgctctatcccctccctctcttcctcttccaccttctctctcttctcatctgggtgctggaacccaagggtgaaactgagagtcagaaagtctcagtctcaaggcagagcggggcaactaatttaaaacggcttctactccggcccccagtgtgactaatctccttctcttcgctccacaggtctataaatgggccacagtaggcacccctttttaaatctgtaaaatccccaaatccattaaaagtgacttcagaggtcccagatagggaccaacatttgttt

SEQ ID NO: 1746 - DNA, 1622 bp, Homo sapiens
tggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaa

SEQ ID NO: 1747 - DNA, 1763 bp, Homo sapiens
gcgagctgacagaggggagcagaggcccgagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttcgcaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaattta

SEQ ID NO: 1748 - DNA, 1814 bp, Homo sapiens
gaggggaaaggaagcgacgcgagctgacagaggggagcagaggcccgagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgccta

SEQ ID NO: 1749 - DNA, 2633 bp, Homo sapiens
tggaggagggacttctctttcggtaaccagctcccttgcggatagtctatgttctccatataaacccagcacttcccttaattgagatacgtgggacttcactccgtccccagcccggaaccacaagtgagggcactgcgtttcctgattgacctctttggcgattacttccgcccaggggcctggaatactggaggcccttcgacggagaacaacaagaaaggcacttccggtgtctgttgccaggcgcgggcccagtgggccgtaggggcgacattgttgccgttgtctttcccccccagtcccggggatggagatgtcgggactcagcttttcagagatggagggctgccgtaacctacttggcctactggacaacgacgagatcatggccctatgcgacactgtcaccaaccgcctggtgcagcctcaggaccgccaagatgctgttcatgcaatattagcatacagtcaaagtgcagaagaacttctgaggcgtagaaaagtccaccgagaagttatatttaagtacttggcaacacaggggattgttatacctccagctactgaaaaacacaatcttattcagcatgcaaaagattactggcaaaagcaaccacaactgaaattgaaggaaacgccagagccagttacaaagacagaggacatccacctatttcaacagcaggtgaaagaagataaaaaagctgaaaaagttgattttcgtcgcctaggagaagaattctgtcattggttctttggacttcttaattctcagaatccttttctaggaccacctcaagatgaatggggaccacagcacttctggcatgatgtgaagcttaggttttattacaacacatcagaacaaaatgttatggactaccatggagcagaaatcgtgagccttcgtttgctgtcactagtaaaagaagaatttctttttctcagccccaacctagattcacatggactgaaatgtgcatcttctcctcatgggctggttatggttggagttgctgggactgtccatcgaggaaacacttgtttgggcatttttgaacaaatttttggactcatccgctgcccttttgtggagaatacttggaaaatcaaatttatcaacctgaaaattatgggagagagttcccttgctcctggaacattaccgaaaccatctgttaaatttgaacaaagtgatctagaggccttttataatgtaatcactgtatgtggtaccaatgaagtacgacataatgtaaagcaggcttcggatagtggaactggggaccaagtttgaggtagtggaaatgagacattgctgaacaaaagagaactgggtttacctgaccctctaaagcgctaagtactgtcagcctgaaaaaaatcttctatacagaaactcttccaaatactatatcagtaatgtctgaatgatttcagatgtgaaaattgacatattttagttgaaatacctttctggactacagacttacatatcatgtgaatacttacctatttctacccgagttgcagcaagtattctgaaagcttaatgcaaataaatcccactttagatcttacagctaactgtgtgccttagaaaccaggtaatattttccttttacttagtgaatattctgctaatatctgcacttttcatgtgggaaaggattaataatggtccaggcttcccctctttaagtttcatgtttacttttgtctaactctggataattgtattttacaaatgcatctcactgtagtatatttttaaaactattaaatattttagagatgtttaacgtaaactcaaagttctcattttagaaaatttaaataacattctttttgcaaaaaagtccaataatttaacagttgaagaaaaacttactacctctttaaagatttgagaaacatttttcaaagttatcagctgtagtccaagctaaatatcttttgtaatctgcaacattttccttactgtttttgggcagtgataaatgctgttctcgaaatagactttattcttacctaggcttcagacaacagttttatagagcagttactgtaatacaatataaaggaaatatgctgttgaaattttaaaggtatgcccagttcctaacttttaaacgaattaccgttcttcctcttggctgatcttggcagagatgacaaaaaaaaccccaaaacaacccatgcatgtataatgtgtgtatacacatatacataagtatacatatactcccacattataacttagaatatttagttttttacctgttactaggtttgagttacatggttgagttgccaaattatttacatgctttgtttaaattcttcatcacctagcaactgtttgctgatcatggatttacttagttactttaatttataaaattaccatttggaaaagaactcaattgggaaatgtgatgacgtattgtacatgttactttttcctttgctataatcatctagggagactgataagaattttggaaatgggagcctggaaactcatctttgtttttttaatgctatgcctcttacgaggaatacgaattggtatgtcctaaaataagaacttaataaaggagggaaatcccttttgtctgctataagaa

SEQ ID NO: 1750 - DNA, 1292 bp, Homo sapiens
tagcccacaccttgacagtacattcagtcactggatgattttgtattgaagtctgtaagttcaagaactaaaacaatccaaaacggctactacaggtgaagttgagagcaatggcccaacctcagctgtatctaccagaaccctttaagattgcctacagaaaagttggacagtgccgaagattccagcaactcaagaagaaaaatggctcattcaaaaggaaggggatagaaagatggcatagagctgtgtctaccaacttactaaaacaaaatgtattggtccctaaagaggaatcatccagtgatagtgacatgggatttcatgaaagccagcaaaatcagaaaagtaatttgaagacgaaagtgaagactgcttttgggaggatgctgtcctacaagtatagaagcaagccagcatgtgccagccaagagggctccactgaccataaagaagccctcctgtcaaacacgcagagccttctccctaggattgtcaaggagttttcatctcccaagttatttacagcaaaaatgagaaagctctcagagaatgcgactatacaacttgatgttgtagaggcagagacagaggagataacccagggaaacacactccttcgggccaggagaaccaccaagcggttatctgtgacatctcttccttcaggactgcaaaaggggccatattcaccaaaaaagagaccacactttccagcacttaaaaaaaagaagcgtggcatggaaaacatccttcgaaaatcagatttgacagtaggaaagcttcaaatgcaggtggatgacctcatagaaacagtgactgataaatccatgaagctactggcccaaagacatgctgagcttcaacagtgtgagtttctgggggatgaaattcttcagtcttctaaacagttccagaggatatccaagagaaccatgaggaagtataaattaaaaaatatgaccacaaaaggacctggagacagctgacctgagactccttgaggaacacaggaaaaggtcttcagacaataacttaaccaattaccaatcagaaaatcgactccacctatgagctggaagtccttcccaccccccaccttcaagctgtcctgcttttctgtactgaaccaatatacatcttacgtgtattcattgatgtctgcctgtaacttctgtccccctaaaatgcataaaatcagctgtaattcaaccaccttcggcacatctcaggacctcctgatgctgtggcatgtctttaaccttggcaaaataaactcctaaattgattaa

SEQ ID NO: 1751 - DNA, 1201 bp, Homo sapiens
gctgcttcctgggaggtggtgctcgcaaacctggcagctgactgggtggggcgtgccttccctggcagtcgcggaggggaaggctgagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatttttacagccatcttcgacatgaacacggatgtaatcatactctcacaattcatgtactacaggttaaagaatcagaagaaaaaaatttctgaagaagatctacggaaggaacttcatttctgctgtttgcattggccatgattgggaacttcacgtatggacttggtgtggttttaaaggcaccagctgctacgtgtcacaagaatacttactttgtgcatcatcttccttggcttattgcaagttttggaatcttattccttaactcttttgtgtcttttgccatcagattgccattagagaataaacatgtatagctacttaatatatcacccaaaaagtacatatatatatatatatatatattctaagaagtgtaaatagctaatgctatagtcatttcattattatatttgaaatgttcatttataaggaaagtcttctctctcccaaagtctcctaattattattattctagcaaacgatcaaattcagatgaagatttcttggtttctttggttcttctgataaaaaaaaaaaagtggggccaagtttagaagcattgaaattaacacatcttagatattaaattttattaaaattataatagcagatattaagaaaaaaccataccatctctgaaaatctctacagagaacactttgaattaataaatgataactgatgccttgc

SEQ ID NO: 1752 - DNA, 1197 bp, Homo sapiens
gtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcaggatattccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatacataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccacagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctacaaacaccagggaagagcaagattgagttacatggcttggaagaagagtgaaacacctcgcaagacccagagaaaactccacatccatttgcagctaattttaaagcccaaataaaagcacaatcttt

SEQ ID NO: 1753 - DNA, 1484 bp, Homo sapiens
gccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatttttacagccatcttcgacatgaacacggatgtaatcatactctcacaattcatgtactacaggttaaagaatcagaagaaaaaaatgatattccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatacataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccacagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctacaaacaccagggaagagcaagattgagttacatggcttggaagaagagtgaaacacctcgcaagacccagagaaaactccacatccatttgcagctaattttaaagcccaaataaaagcacaatctttggaatcactctatctttggtcaggcaaatgtttaaagagcaatattatatacatctagggtaagaacaattcattaatttagatgaatgaattgtcaaaaggttgttttgcctgtaaatgtgagtaaattgaatatcaagtcatcatgaaa

SEQ ID NO: 1754 - DNA, 1737 bp, Homo sapiens
agtggtctcctgccgccacctggaccggggacagtaacgcctagggagccccaagacctcttgagagagcatttcagctctgttgacaaacctcaaccacttgagggacttcgctggaaagaaacgttctagaaagaccaagtggataccaggagccccgtgaggtgcgtgtggcctcagcttgcagaggagtgcacttgccagacacttcggggctttgaagagcacagctcatctaagatgggcacaggtgcatcagagaaacaagcagagcagaaggtccgccgtgccttcgaggcctccgaggaagcccacgggactctggcagcctcaaccccctgggtggccatgggctctgcctatggttcctgtacctgcttgggagcccagcctgtaactgacctggccctctggcctgtcatctactcctgcatgggattttccccacaagcttacccagccttctgggcttacccgtgggtgctctatggtgggtatctctggatgggttatccccctccagctgccttggtgccttcagtgtggctgtattggaggggcgcctccagctttgaccccctcataggaagtccgtatctggctgccttggcccccaacctatttcctttccccatgaaattcccacccacctactccttggcttctcccactctgggcggggccacctccagccactgtccccaggtgggatgctggactccagccagctcagcccccagggctgccgtagaggggccatccagaggagctccctacttgaagacatgcaaagcccctccctcagaatgggcctccaggttcggtatttgggcacctttgccctgctgcagttcagagctccgccctctgcccccttcccccattgaagattctcagctggacccgggctgctcccgctcctcctcccggtcaccctgcagggcccgccgccgcctctttgagtgctaatcagccctctagacccagacccacccaacaatcagagacatgtctggtggagcccagccagctgtggactttaagtttttggaagagtctcagatgtaggttgtttactattcttcagtacagagtacacctcctggactcatgcaaggcccctctatttgctatttctctttactttgtttttctgtttgcccttcaaccctgatactggcaccttttctcctccccagactgtcctgggcccgccctctagtagatttgctgtgagtcctcaaacatgcatgcatgcaaccttgtaaaatgagcttatttaagctcaatccaacctgtagaagcgctcagttagaataggcctccaggtttggtatttgggcacctgtgccaccctccagcccaggactctctctgcccctcctcagcaaagaccctcagcaggatccccgcatccctggccaccctgtggggcctgctgctgtctcttccagcattggtgtgtcctccagggaaccacacactcaagcactttggaacccatggaatccagtgagcacgtgctgtgggctctgcctagaagcttccaaaacctgtttgttccagtggacacagagtaggaaatgctgactcgttcagagcgctagtgcccttgggtccttgcgggtgtgctcttctcactcctcaccccatcagcaccttctggggtaatgcacacaccagtaaaatgtacagtgcatgcttttaaaaatttttaaataaatgatactatgctat

SEQ ID NO: 1755 - DNA, 4235 bp, Homo sapiens
gttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtgccggtagggccagcggcctgggagccgcggtggggcgggaggcagcggcggggcgggccaggaagctgtgggaagtggggcggggcgtctttggggcttctggcagatggcgggttcctccgcgagagccgagaaccgcctactccaggaggaaagcccgagggttgtgggtcctgctatagccagggccaagctccaggaaatcgtggccattcaggggtagtttgcagcctcatttgtaacattattgtgttgtcctgtgcatttccaatgcattacataaagacatggtcgcttttaggagaaatgtctgaaaaactaagaagatgcagaaaggaactgactgcagccattgaccgggcctttgaaggagttagttattcccaggagtgcacaggccagcagaggctggaactgagcgccgcgccgctctccttctcgctgcccgtgcacaggctcctctgcagaagacatcctctggcagcctgctcttctgctgctccttttgctgctgtcccatgtgctcctgagaatgagaaccctgcctttgcaacaaaccatgccccggtaaatgcaaaaccacatgctctgtgccccgagagaaaacctctaaccagcaaggaaaatgtattgatgcattcctccattttggcacctgaaagagagtcttggagaactgcaggagagggggaaaactggagaaaagaaaatttaaggaaagatatggagagagatttgaaggctgactcaaacatgccactcaacaattctagccaagaggtcacaaaggatctgcttgatatgattgaccatacaagcatccgaactattgaagaattggctggaaaaatagaatttgaaaacgaattgaaccacatgtgtggtcattgccaagattcacccttcaaagaggaagcctgggccctgctcatggacaagagccctcagaaggccacagatgctgaccctggcagcctcaaacaggcttttgatgatcataatattgttgagactgttctggacttggaagaggactacaatgtgatgacgtcttttaaataccaaattgagtaaggacagttatctaagctttgattccttacagcaggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgtgtttttttgattgatgttcaatatacccagtacccatggtaggtgtgggtcatgggcctctgctgtgtctcttagtgttcttttccacgggcccctaaaaaagtacaggagtggccaggcacagtggctcacgtctgtaatcccagcactttgggaggccaaggcgagtggatcacttgaggttaggagtttgagaccagcctggccaacatggcgaaaccccatctccactaaaaatacaaaaattagccaggagtggtggtgtgcacctgtagtcccagctactttggaggctgaggtaggagaattgcttgaacctggaggcggaggttgcaatgagccgagatggcaccgctcccctccatcctgagtgacagagcaagactctgtctcaaaaaaataataatttagctggtcatggtggttcgtgcctgtagttccagctacttgggtagggactgaggcgaaaggatcacttgaggccaggaggcagagattgcagtgagctgagatcacgccactgcactccagcatgagtgacagagtgagaccctgtctcaaaaaaaaaaagaaaaaaaaagggaagaaaggaaactgaatctcagggaagtgcccacctcctgagctaataagaggaaggaatatgggggtgaggcagagctggcaaaaggctgttttttgttttgattgtttttaaagaccaagtgaagtatagtataagaagtggggaaggagtggaacaaggagttagatctgtaactgtgagtagtcaattgagataactcaatacctttggacctgattgtttttaaagactgagggtagtataagaagaggggaaggagtagaacaaggagttagatctgaaactgtgagtagtcgattgagataactcactacctttggaccagccagggctgtttataagtgctaaagcccgaacaaaccaaagagttggggagaaaggcctaactaacagctgagtgattgtctaacagactgtcttttaggccagtgactctggcatagggcaggctgcatagccagcaacatcccttaccacaggtctagtgattcctctgggctcaaatgtggaggctacacacccactccttagcagaggttggcctggcacctgctggtgccccaagaactatggcatggttagaccctggccacttgattgcatgtgcctccccagtgggcgtgccctggttcccaaccagttgtggccactgccactgccctgcctggggcaggagttgaggttaaggctaactacaggctccttccaggccacctaccactcagaccctgcaggaggtagcacaaagcattcacagcctgtggagtcagaggccaatttcttctccctgagcaagaagaatggaagcaaatgaaaagtgctcacagtatgctcaactgcccctgctcaggtgaagaatagcctgtctggatggagagatgtcaggctacttgatactcagaaaaacaggtctcaaaacagtgccttccaaataatacatgtggatgtggacactcttctatagacgaggtggagcttaattcctgtccttacccccatattcccacctcattaccaccctttgaaggtgaactagacttaatgatacttcccacgactaaagtagggaaagggaaaagtcacaaacttatagtggggaagcctggcagacacctaaccaagtgatgtcatgtatatgtcatgagaggggtgcatcacttccctggtattcctaccaaaaacccaaattcccagtgtatgatcttgagacaaatgttagacaaatccagacgtggggtacattctacaagatacctggccagaactcaagactgttgagatggccgggtgcagtggctcatgcctataatccccgacactttgggaggctgaggcgggcagatcacttgaggtcagaagttcgagaccagcctggcaaacatggtgaaaccccatctctgctaaaaatacaaaaattagccaggcatcatggcatgtgcctttagtcatagctacacaggaggctgaggcaggagaattgcttgaacccaggaggtggaggttgcagtgagccaagatcgcatcactgcactccagcctgggcaacaagcaagactccacctc

SEQ ID NO: 1756 - DNA, 1924 bp, Homo sapiens
gttattgcgactttgatctaaacagctctgtaaagcccattttcacatttttaaaataatatgctttagcagcaggtgaggaaaacttaaggcatggcacatttattggaaaagcagcagtgggcggcttggtttaatggcaacaccactagataactgtctaaggccctttccagatccaatggtcaaggtaacagcagaaacaaagaaaatctcagaggtctcttcttatgtctctgctaacaataaaaagaacagcttttggggaagtgggctgctttatcctgtagccctcctcagatgccaagactgctgggctggccaccagactcacgtcctcagtaaggaatttacctcctacttttcttcgggggcaggtagggaagcacagcaccagccctcagctgtcttgggctccctgatctggttaaggagagtgtatttactcagggccatggtggtgcatggaggaagccaaccctgtcagcgctggctggtcatcagaatggaagtgggaggacatccttcatttccaggtcatgcctggttaacatttcaccttaactgaggggccaaagagaggctacgcagcctggatcagagctccgacagcccttacctggtggcttgttcgtggaatttatcacatcctgttgtaacgctctgtttacatctctgctgcccagccagactccgccttctgtgattttctcatcccaccacccagtactgtacatgctcaatggatgactataaacaagtgaacagacagcaggagtggctgcccttatgcccatggaactgggcctctcaattcagctcatgttggtcatttcagatcatctgaatgtaaagggtcctctctgtctctgaccaggcttcttgcaggcctttggcagccgtggagctctgagagagactggtttcctgagggctgggcaccccggtctatttattgggaggccacaaacagaaagagtgggcatcaggaccaacgggcacatggccaccacccagatacgtgactctggcatgtatttcacttctctggggccagatggcctcttcctaagattctcctcagtgctgagagttcttcagtcctgcctgctgacttccctccaggacagaacagatgcctcttcctcccatagatatgatgcaagaactgagctgtccaagcaaaaaaaaacctttgaaggaagaatttctgtgctgtgagtggtttactctgagaataggactcaagttttagaaatctttgttcaatgtcagagatagagcgactgtaatctgtgagccaagaaaaaaggtttgtaaaggctagaagaaaagaagcccatggctaagaacttgtaaaaacatctacagcaaacaagagttccaagagaaagactgtgaaacagcaggcccacaggagctggagagcgagctttgaaacgatacaaaattaattgtctaaggggcaaataaatggtgcagtacacaaatgcaggaggtgacacaaacgcacctggattcaacagaggacaagtagacacatctatgtcccaggctgcactaatgaggaaagtccaccaggtgggaagtaggtaccactgagagtttataaggctaaaaaccccagtcttgggatgcggagaaggagggaaggaagtgagaatgaacaggaatggcatattctgttcacttcactgacagctttgcactgtgcattcccagctgggcatgtcccagacatgatctcttgcatgggctgtactaacgaacatcaaatattcaggctggcaaccagttacatgaaccggtgtcaggagtgcacattaataggcatctgactagggcagggctgggcaaactacggcccctgcgctacatccagcctaaagcctgtttctgtaaataaagttttatcaaaacaccc

SEQ ID NO: 1757 - DNA, 2650 bp, Homo sapiens
gggaaccaatgggcgcggccggaacgcgggtggcgctcggcgctgctctttcgcggtttgattctggggtggggcggcagcgggagcgcgcccgcttttcctaggccagcgggcggttgtctgtggctccgcgactgggcgccccgtcacggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatgctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaagaata

SEQ ID NO: 1758 - DNA, 2756 bp, Homo sapiens
gcggtttgattctggggtggggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtatgttcagctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgaggtaggagcaagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagagggtaaccacagtatccagggttctcgaggcccaacaactggtccttcagagttaactcagttaacattagagagcctgctggggaaggctgcaaagcggacaagtaaggaatatctaaggagcgcctacacagaagcaggagcaacagaaagccaggattcctcgatggagcaaatagatagaaataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccacccggactggttaaatatgttgagcccaccaatcgttcctcccagtcaacagccggctgagcagcgtccagattcctgtgaaagtttgagtgttcaaggtgggactatgaaaaacgatatgcataagaaaataaaaataatttactataaatagagagaatccatc

SEQ ID NO: 1759 - DNA, 2617 bp, Homo sapiens
aattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatgctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagagggtaaccacagtatccagggttctcgaggcccaacaactggtccttcagagttaactcagttaacattagagagcctgctggggaaggctgcaaagcggacaagtaaggaatatctaaggagcgcctacacagaagcaggagcaacagaaagccaggattcctcgatggagcaaatagatagaaataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaag

SEQ ID NO: 1760 - DNA, 5901 bp, Homo sapiens
gacccggtcgcagcgcccggggcggctcctcctcgagcctgggaccgccgcgctcccgccgccgccgcgtgctggcgtgactcccggcccgtgccgcgccctcccgcgtccgcagccggctcggcttcctgcccacccagacgtcgcttctcccgggctcccggtgtcggctccgcgcggagggagaggaaatgagtgcggcggcctcgccggcgtcggagcggggttggaagagcgagaaactagatgaggctcaggccctggcgcggagttgcgccgcccgcagacccgacttccagccgtgcgacgggctgtctatctgtgccacgcacagccatggcaagtgcttcaagctgcactggtgctgtcacctaggatggtgtcactgcaaatacatgtatcagcctatgacccctgtggaacagcttccaagcactgagattcctgccaggcctcgggaacccacaaacaccattcagatctcagtctcgctcaccgaacactttttgaaatttgcatctgtcttccagcctccccttccccctgactcaccgaggtactgtatgatttcagacctttttattgacaactatcaggttaaatgtattaatgggaagatgtgttatgtgcagaagcagccggcaccacattcccacagaatgagccctgaggaggtctctgcacacgatgccttaatttcaaaagagagcaatacaccaaaaatagatcactgctcttctccctcaagttctgaggactctgggatcaatgcgattggggctcactatgtggaatcgtgtgacgaggacacagaagaaggagcagaactgagttcagaggaagattacagtccagagagcagctgggaaccggatgagtgcacccttctctccccctcgcagtctgacctggaagtgattgaaacgatagaaacgactgtgtgagagtccagacaggaagccacagcctcggacccacgccgagcttttgtacctttgtctggtggatccttttttccaatgctgttgatattttctacccaccccgccccgctccaaccaacaaccgtagcagttcagtggtatgctgattagcttctctccgtcttacaactaagacattctttttattataaacagttttcttttgtatcctgacttactttctatgtagcatctggtgtcatgaattgtgaccccgccttaatttcactgggagatttgaaggcggtgaagtgatggtcgcagagaatcttggatcagattgaggaggtaccgaaagggaaggagccggtgttttctcggtagccagtccttcacagagactcttgccattccctttggcatgttcacaggcactcccgtcctgtcctgcttgtcctacgcaagtagcactccctactgagtgtgcactggtagatgccgtttcttcccttccccttctccccacacctgcactgggtctggatcagagctgcctcggcttacttctgggaggtcactggaggccagctcagcccatggtttgtggccagtgtctgtacaaggctccgtgactggggctgagctaaacattcacatgagaagagatgacctcatctgtctcatgctcaatccagccttagctgagcacctgtcccctgcagggggctgtggggacacagcatgaataagacctgattcccaccatgaaggggcccacagtcctatatatgacacattcaactcatggcacccaaaaagctctgggaacccaggggaaggatgaggtttacttggctggggctagctggggaatgtgtttcagcatttgagctggcttcttggtgggttccccaacatttttctgcttttaattgttcttcaagtctgggaaaaactcttaggaagttatataggtatcacatttaggtggcagccacatctgacatcttaaggaaaaaaaataaattaatagttttagttagcatggaaatgctacagacagaagccctttagggattaggactgaatctaataggtttgattaattctgcttcatttggttgtatgaagcattcgtatggtttaagtgaggaatggattagaattcagtgtgatgcatggatttttatgcagctgcaaaagcagttgaaatagtttgctgctaagtcaggagaaaatatccagtgtaatagccattcactttcccacacagtctgtctgttgtatgtgttctctcccctcacatgcacaaaatagtgactaattctttcttatttagctctcttcagaattctacttctactctccatttataccaggtattcttgtgagtcagttaactgctatttctccaaaccttctatccatgaggcatagtttcaaatcctggaaattttaagtatggcctaatgagaacatcagagttggagacagaacagtacttccatcctaactatccagaagcgcactctcaggccattgtgctctgagattcccttgtgctctggcaccattatggtacatctctacgtcacattaatttttttttttttgagatggagtttccctcttgctgcccaggctggagtgcagcggcgtgatcttggctctctacaacctctgcctcctggggtcaagcgattctcctgcctcagcctcctgagtagctgggactatgggcacgtgccaccacacctggctaattttttgtatttttagtagagacgggctttcaccatgttagccaggatggtctcgatctgaccttgtgatccacccacctcggcctccccaagtgctgggattacaagcatgagccaccacgcccggccggatttgtaagaaaaagttgtgttctcccctgaagcctccatttggcatcattcacaaactactcaaggaagaatttgctttcccagttgtatgtataatttaagtcgtttactagatagaacttttttttaggtttagatggccaagacatctatatggtttagaaggcagagtatacattttcctttgcaaacagtatgagttaaaactttctatgctaaatgagaatgcggcataaagtctccacttactgaaatttaaagattcaacaagacaaaccgagaagggggtcagaggagctctaggaaaggcccaggagagggcagttggaggcaggtgtgagcatgaggagcttccccctgccagggcatggctcaggtggcacagggacatctgatgaaccctgcccgaggttctcggtgcctcccgtgcatgagtggctcactgaaggcaggtgtggaagccaaatgcctgcaagccgtgtgtcaggccacagcagtgcagtcatgcatcacgcactcaggtttgtaacagcaacaccagggccctgtctagattcaccctgtgggtgagcccgttctccagatgggcgtataaaggggctttctcctctacaccgttcctgtcaatgttccgtacaggcccacattcccaccactaagccaatggagtcaaccagatttctaaagccatggatatacgtggtcacggggccacatttctgcagctggctcagtggcaggcttgggccgtctctcagtaccatctaagacttctgtctaggttcctgtttttttagactcctgaactgccattctgattagacacaattttaatggaatttttggatttaataatagttgataatcaccttatgtatttgcacaatctctttataattaaaaactcgctaagcttcacttgctactatctactatatagaattagagacattccattggattctaagcatcagacactcctggatctcaaaatgaccttttctaaataagcacaagatttatttttgtcctagcactgttgataacactctgaaatatgttattgaactggaattgtttctttatgcttgcattccaaaaccaactgaaacagattgtagtttcactttaaattctaggcctgttctatattatgtgaaggaattctctgtaacgctgatactatgttgctaatttgtgtacttacagacactttagaaaatgtttagactgcaacatgcactataacattgaactcagtcacatgaagtggttaacacttgcacactgactgacagatatgaaagctgtatactttggacccagtaatatgctcattggagcaagggttgggctgtgtggatggataaactgctttcttgggtttacatggaaacctggtaccactcctacttttggaaagttggtataaaagctattaggtagaagcttaattccactaaatgtagaatttagttttcttctctaaccaagattttagaagtttcaagtttcaaatatgcttataacttttccaagaaatgatgattacagtgcttttgtggttacaactgtttggtatattaaaaaataagggtttactatcacatctaggtcttttttactatgtcatttttaagatatgaaataagaatctgaggacagccctgaagaacagtcctttcctgggaggggaagacttgtaattcaaggtcatacaatacaaaataaaacaaaaacaaaagcaccaagagcagaacaaaacaacgtagttgctttcctgaaatactttttggatttgattctatcttgggagtggtggctttacttttttttttttttttttttttttgagacagagtctcgctccttcacccaggctggagtgcagtggcgcgatctcggctcactgccagctctgcctcccaggttcatgccattctcctgcctcagcctcctgagtagctgggactataggtgcccgccaccatgcctcgctaattttttgtatttttagtagaaacggggtttcaccgtgttagccaggatggtcttgatctcatgacctcgtgatccaccctcctcggcttcccaaagtgctgggattgcaggcgtgaaccaccacgcccggccggctttacttctaatcctccacttcttggtctatttgaaccatcacaagtattttgggaccgataacaaaccccttttatgctaatttaattcttgacttgggtaataggtgcacctggataatttataaagctgtccatagatctaagtttagtggtacagatactactgggcaggagaaaaagcacaagttaaaatatttctacagtcagctcttaatattcccacatcttgtttgcaaaattttatggtcacgttctggcttttttacatgaggaaaacaaagttttaacagttttctcttctgtccccttctccagaggaggtgtgaaccagaactgaggaggccagttatattttaggcttttcagtagtacgattttgtcctctcccactgaggaggagggaagaagggggaagccagtgggagttccacacacgtggtcagtgctgtaagttcccggatatcagtgtctctcacatcaacacagaaatagggcacttctcaacattaattttggaattattcaccatttaaaaattgtcactgctctttttcattactgtagataactgagagttagctgttctaggaaaaggccatgtttcagttagtgctatgacttcttttttcgattaaggttgaagcagtgttctcttagtagcctgaacacttctcaaagcgacttatcactagcggctttaatattgagcttctatatcgttgtgtccacctcactttttaaggctgttcatacctggcaatattcacttactctgctatttttaaaaactattttaaagttttaagcacaatgttgactcttctgtaatttcctaaaattatattgttttcctacagacagctcaactttccttgatatgtaacactttaggaaaataactgccttgtaaaataaacgtgattttttttttcttttataccagaa

SEQ ID NO: 1761 - DNA, 3538 bp, Homo sapiens
actttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcagaatccccagccctggtgaagaagaggatgcctgatgcgtgcaccctgggaagggctggaatcggtctccccaagatgtgccttcacatggctgtccggcattcgaaggctcagaaaacagggccgggaatcctgcaacagcggcagaagccgcccgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagagcttgctgcaaccctctgcttggagggatggcctctgcggtgcttggctagcaaagggaagcttcactgtgtctattagtacatccccatacactccacgcctcaacaactgtcagcactcactccctcccggcccctcacagggccctttgcacccacacctcagggactcggtgtccctccactcaggtcacgttactccatccacttctctctccttctccctctgtcaactccaaatcccctctagttctccctcccctcctacttctctcacactcaccagctacacgtactaattcagattttgcacatgttggtggaaaacatgtcaagccaatgtgcagaccctaaggcttttcacacgctgctcactttcgcatctcacggtgcagaaggaccaatgggctccaggtttacaagcctgactccgagaagcctgttgattctctgatgtccttggcctgtgattcgggtgactgggctgccacctgggtgttttcatgatgggactgccgcacagaccacagagaagctcaggtactgagcacgttccagatacactttaacatgcacaggccactcacacaggctttatctctgtctcgaaactctgctgagtttgctgctcagaccaacaaggtgcagcagcagacacccacatagcaccaggtctgaagccagtgggtattagtctgcctggttgggattagcaaagtcagttactcacatatgtgcttgggagagaataggggagtggagagagagagagagatattgaggaagaggaaagagaagcgacctcctactctgggaagaactcacacatgagagctgtttcctgttgttaagtgtctcactgagctcccctctttctcccccaggaagggcttgagaggcagtagaccagagctctgggctcctctttaccttgctgatgttggggtatgagtcctccaacaccattttgtcccaaggagtatgtgccccatcgtcaatcaggcagaatgcagggcagttgtcggcctttttcatggtggaggccaactgggaaaaaggcagaagggtctgggtcctgggccaagtgaggccctcttccctccaaagacccgtgggatgctctcagaggcggattctagggtggtgggagctgctgacaagtttcctctgatatccctcatgacatctatggcccaaagccattttgttcagctctgaacagtgagtgccttgccagtaggcctcaggcttgctggggaacatgatgtgttcttaaaagttgccttgttgcctttctccacacccagactgtaagcgctgatgggcagagactctgccctccacttctcactcagtgctccccaccaggatgggcttaatgccttttaatagaattagaaaatggttctgctggacagaattgggaaatgccactttccttataatgaagttataatgaagttagaatttccaagaaagggactgtagctgaggaaaagcggtttgatcattgacagccagctcaggatctgagagttctttgccatttggggttattatagctgcatggccatggtgctgaaccttaggcaagggcaaggacacctccctagttcccagtcatggtgaggacctgtctgaaacattcaaactagactttactggaaacagagaagtctctgcattcagggcagctggcttgcaaggtaaggcctgcagtctccacccgcacgctaacccatgaggggatgccagagagagcccttcccccttggtcctcattcctggctcaattttctcccacaaagcgggcactttctaaagatgataggcaactgccatggaggaaggcagttttagatgcctagctggcacaaagtccagaggaagggagggagaagggctgagttttgtattactgttctacctttggagattttcctcatgccaagatagggtgtgtgtgtgtgtgtgtgtgtatgtgtgtgtgtatgtgtgcactataactttatgaaacactttttttttttttgagacagggtctcactctgttgcccaagctggagtgcagtggtgcaatcttggcttaccgcagtctccacctcccaggctcaagtgatcctcccatctcagcctcagcctcccaagtagctgggactatgggtgtgagccaacacactcagctaattttttttttttttttttggtatttttggtagagacagggttttaccatgtgggcccaactggtcttgagctcctgagctcagggtgatttgcctgcttcaacttcccaaagtgttgggattacaggtgtgagccaccatgcccagtcagttttttattttttatttaaacagttttgggggaacaggtggtttttgcttacatggataagttctttaatggtaatttctgagattttggtgcacttgtcacccgagcattgtacacggtacccagtgtgtaatcttttatccctcatccccctcctacgcttccccccccgagtccccattatataattctttttttcttctttttgagacagagtctcactctgttgcccaggctggagtgcagtggcatgaacttggcttactgcagcctcctgagttcaagtgattctcctgcctgaacctcctgtgtagctgggactacaggcatgcaccaccatgcccagctaatttttgtattttttgtagagatggggtttcaccatgttggccaggctagtcttgaactcctaacctcaagtgatctgcctattttggcctcccaaagtgttgggattacaggcgtgcgccactgcgcctggtccattatgtcattcttatgcctttgcatcttcatagcttagctcccacttataaatgaaaacacaggatatttggttttccatacttgagttacttcacttagtataatggtctccagctccatccaggttgctgtgaa

SEQ ID NO: 1762 - DNA, 492 bp, Homo sapiens
atgcagagtgtagactctatgctggggacagtgggaggctgtggaggaggagaggctgcctccaccttctcaaaagatccctctggctgctgtgtggggaatgactgtcgggatggaggcagaggcctggagaggaggcacgggaggtggtctaggggagaagggggagaatctgggctgtgtagtggtggccagatggcttctgaaattgagtactgggatggattagccatctctgtcatggaagtggaaaaggcgtttggtagcacgaatgttctgtggaagacagagcccttctctttatgggcatgcacagctgcctgtcctcccagtctgtctcccaccctgctagcgctgggcctccccagagacgggaaagagctggcagagcagggctccctgtggactgtacttgagcctggaggagactggagccacagtcagagccagctgggaacccctgggcgcgggaaaggagctctaggtttttag

SEQ ID NO: 1763 - DNA, 1401 bp, Homo sapiens
ggtcccatcgaggcacccgcctcattggctgtggctggctcgcaaaagtggcattgcgcatgcgcgcttccttgcgcgagccgggctgtcgggtgtgttttgctctccagcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgga

SEQ ID NO: 1764 - DNA, 1276 bp, Homo sapiens
attgcgcatgcgcgcttccttgcgcgagccgggctgtcgggtgtgttttgctctccagcctccgtcgtctctgcagcactccgggttctcctccagagcgctagtcccaggagctcggaatgttcgtggaacttaataacctgcttaacaccacccccgacagggcggagcaggggaaactgactctactctgtgatgccaagacagatgggagtttccttgtacaccactttctctccttctatctcaaaggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactgg

SEQ ID NO: 1765 - DNA, 580 bp, Homo sapiens
aaaggactgtggaacatctcagagcctctcagtaggagcagaaaagttactggggagtacagatgcatgtatgtgatctgcagaagctggtcaggatccaacttgcatttactacatttccatggatgttcagttgccatcttctgcctactcctgagctttcatccaagagaaatcagtgtttgctttacaagacttccggttgtctaacccaaatgccaattttatatgggcaccctgccactcttctaaaagactacattttgcaggcaattttgcaaccaggaaagaagattcaaggaggaactgaaatacagagaggctcctttgcaaaccagtatcaaacagatgccagtcacttgtaacatctgccctaccattggaataacataatgagaggcctgggcaacccagagagaagtgtaaatgacatcagttactaataagaacactgctgaattttgaaaaacttttgcatgctttaatttctccatattttaagtaattatactaattatgagagtgctgtgtattattagttgtttggtcacaaataaaaacaaaattcatttcaaatata

SEQ ID NO: 1766 - DNA, 2577 bp, Homo sapiens
atgtggggacccggggtcactgctgagggcctgtcggtggctccggcgccgccgcctctgctgccgctgctgctactgctggcgctggcgctggtggcgccctcgcggggcggcgggggctgcgctgagctggcgtgcggcgagcgggagcgctgctgcgacgcgaccaacgccacggcggtgcgctgctgcaagctgccgctgcacgccttcctggacaacgtgggctggttcgtccgcaagctctccgggctgctcatcctgctggtgctcttcgccatcggctatttcctgcagcgcatcatctgccccagtccacgcaggtacccgcgcggccaggcgcgcccgggacagcggcccgggcctccggggggcgccggaccgctggggggcgcggggccgcccgacgacgacgacgactcgcccgctctgctgcgcgacgaggcggcagccggctctcaggactcactgctggacagtggcggcggcggccggggccggggaggcggcgggcgctcggacccctcctgcgcctcagagcacgagatgcgtgtagtgtcgccggtcttcctgcagctgcccagctacgaggaggtcaagtatctgcccacctacgaggagtccatgcggctgcagcagctcagccccggggaggtcgtgctgccagtgtcggtgcttggccgccctcgaggcggggtcgccgcggagcccgacggcggcgagggccgctaccctcttatctgagcgctcggggatcggcggctggtgcagggctgggggctgcgggtggcaagcaacggccggggtgccgccgccaactgcctcagaccttatctggcaccctggcctaactgcccggcaccccgcgactgggttggggtcactcgtctccctcgcgttctcccgggatcttatgtttctctgcgtttcattccgttcaaagaaacgtggggcacgcgcggcgggtgcggctgcagcaggcgaccctccagcgcaccttcgaaggacgtccctgccctctgccttgcctcgtattgtggttcactagtaagtgcctgcttccctagtcaaagagaacacgtgagccctttggtgcgtcgagagaagggcggtcttctttagggctgaggagaaaggaccgcagttccactcctttccctacctgccgcctggacaggtctcccagggtgggcagagggcgaggagccgttgaggaccagccgcgaccagggactgctgcacgtgggtgtgggagagcgccacttggttatgatgaaatcgctgccatgcggcagaccccccaaaatccctcagtgtcttcctgatctagcaaatagtcacagctggtgtttcacaattaggtggagtgcggggagtgggctaggggggacacctgtgatacaaggttagctgctgtacctactcagggaacagcaaccatgtatatccattcggctggacttttgattgttcaataactgaggaggtatttatatttatttgtcttttattctaatatttttaccatgcattgaacgcaacaggagggtatttcagcaaattcacgacaaggtaatcgtcttatcactttttgtaggccattaatggtcaggaaattgcccatactctgtcattattgtttaataaatcattaaattatttcattaaaaaagaaaaacaggtatggtcaaacgaggaagcatatgtgacataaaaaacatgaaggatatcttattttcactatttgagaagaatatattttatttttagtactgtggcataatatataactttttataataataactgtatgcattatgtagtatagcttttaattgtatcattcatcacagttatatgtaaaaataattgacatgtatatgccataccatgaagcatatgatgttgtgcactttctcctccatttttcatttggaatacattccacaacatgatccaaaacataagaacttacgacttgtaactcgtttaaagccattaattgtgcagtaatgtgctacaggattcaatcagcttctcttaagaaacaagtgtcattgtatcagtttcctgttctgtgacacgccctttaaaagtaaaagataatataacatattttaatacattgtgtgtaatgtacatatgcatattgtctatgtactatatacacattgtttataatattgttattacagtttgtcattcacctgaaaggagaaggaaaagtacgaaaggtttctctgcttgggaaaaggtgaatgttgttatatcaagaacgattacacacatggatctcatacatgtttttagaacattgttcttctgattgaagaagtctgatgctcctgaaaaatcttaaaatatctgacttgtattgaagaaaattatttaattaaatttttaaaggctggttgaaaaagtctgacagttctgagaattttttaaatgtctgaattgtaataaaaaaatggtttactttaaacttctaaaaactaatgaccttgtgactaaagaaaaatcatttgaagtgtattaaaaaatagcaaaacattaaaatcttttctctgtgcaaatttt

SEQ ID NO: 1767 - DNA, 1636 bp, Homo sapiens
acgttgctaagctatgtaacatatcttaacaaccagggagccacacaggctccttggagtaagagtgtgagaaactggatgaagacagctgtattcttttggaagcgttcgagattggtctgtctctaccaactaaaaacttctagcttaagtgcagagatttaaggagatcaacaaaaactcagtctagacatattatgaggctgggagggtatcaacagacttgagttcttgtcagcaagatcacctgcttttaatattgtcctcagggtctgagcacatctggaagtgaggtcaatcaagttagaccccaaaaacttttgtgacaacagtgaagaggggaaaataaacacaccacaaacatgaacctcaaccccccgacatctgctcttcagatcgagggcaaaggcagccatattatggctagaaatgtaagctgctttctagtcaggcacacccctcatcccagaagagtctgccacatcaaaggcttgaataacattccaatctgtactgtgaatgatgatgagaatgcatttggaacattgtggggagttggccagtctaactacttagagaagaacaggataccatttgccaattgcagttacccctccagcactgcagtccaggagagccctgtaagaggaatgtcgccagccccaaacggtgccaaagtgcctccacggcctcattctgagcccagtagaaaaattaaagagtgcttcaaaacttccagtgagaatcccttagtaattaaaaaggaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaaatcctggcaaagctctgtagcattttgcatactgattctctggcagaagttttacagtggctgcttcatgcaacttcaaaagaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaagaggctgagcacaagcctccactacttataagaagaaataatatgaaaatacctgttgcagaatatttcagcaaaccaaattctcctcccaggcctaacactcaggagagtggatcagcaaaaccagtgtcagcaaggagtatacaagaatacaacctctgtccccaaagagcatgttatccttcaacacaccggaggtagaagttctagactgggtgaattctttcatgaatatgagcttcacatttacatcatcaaattatttttcaaatgaatatttttggtattgaggaatcaagtggtcctctttatggtggcacatgtaaatctaaaaatacctgtatgtaatgctacaaataaatattactggaaatgatatttccatttgtagttaa

SEQ ID NO: 1768 - DNA, 1949 bp, Homo sapiens
acacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtggtaacagaaaacaatccagatggggtgcaggtgctgtaaaataatacaaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacg

SEQ ID NO: 1769 - DNA, 1943 bp, Homo sapiens
cgcggagccgctagcgtctcccggcgcggctgcccgaggccggcgaagccatgggcgccgggaccccgccgccgccgccgccgccgccgtctggccccaggaagagaagttaaacttctagagaaacctaacagacaatatccacaacaggtggtaacagaaaacaatccagatggggtgcaggtgctgtaaaataatacaaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacg

SEQ ID NO: 1770 - DNA, 895 bp, Homo sapiens
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagttccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacgtacaagctgtcatttttgaccacatttccagaaggaagacttaagtaccaacatgttaatttcctaataatttgctaaatttaaataaattccgtagacagagcaaattagaataataaatgagccctgtagctggaaggcaaattagaacaataaagttaataaagaagttagaaagaaaactgtaa

SEQ ID NO: 1771 - DNA, 753 bp, Homo sapiens
atggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtctaaatcaacaggagactgatgctgctcatatcttgaagaagcaactggcatccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacgtacaagctgtcatttttgaccacatttccagaaggaagacttaa

SEQ ID NO: 1772 - DNA, 2862 bp, Homo sapiens
gaagattgctggggactccacgttcaaccgaatcccacgctggtgggaagaggacgcggtcgatacaggcgtcccgcgggtcactctgggtctcgtcgggccacctaggagagtgccgcgggagcttgacggcagcctgagagcggcgttctacgcggagcggcgggggttggagaggacaacgccaagacggctgggaagccccaggccagcagcggaagtccactcggcccgccctgcgactttgaaaccggtgccccggaccactccttggagacggtggcgcctcttgcgtcatcacgcgggcgttggagcttacgccatcgcgcgtcctagagtcctagcacgctattggctggctgtcaagcaatgggaggagtcgtgagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagaatgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttccggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatcttgattttagaagcgaatcgaacactgtgaatcacagtttcagatataaatcataactatttataatatggataaaaatgaagcacaaatatgatagatacaatcacaacaatataaaatactgaatttgaatgttgtagcttgtgagctttctcaaatctaatgtgtatctttttaaaatttgtttagatgttttttaaacatctcttaactttctttcatctagataaggcatttccttttcttccaataccaagcaagcaaaaa

SEQ ID NO: 1773 - DNA, 1588 bp, Homo sapiens
gcagctgggtggagcctaaagccgagccctctcctgtgacctcggctgaaaagaagaagccagtgtttgagaaaagcttcgtgagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagaatgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttccggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagttt

SEQ ID NO: 1774 - DNA, 465 bp, Homo sapiens
ggctgaaaagaagaagccagtgtttgagaaaagcttcgtggtctgtgttctctagttgttccctcttctctctgacattcctttcgtcgtcgccagaatttttgtggatttggtggttgtatgaagaataagtgaatctaccagaacttcctagtagctaagatcttgattcccagaggatccagtaactgagacacctgcacactttacaataaataaaagacaaaggatgacataagaacccatggtgcttatagttacaagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatt

SEQ ID NO: 1775 - DNA, 881 bp, Homo sapiens
ggaggcgtgtgcctgcggcgcggccccgaggcgtgtgcgcggccatgtgcgcttagcgcagcgcgctcttacctcagtaccccggccgcgaccctccgagcccctggagcccgggtaaccaggccgccggcgccggctcgcggggacccgccaccctggaagccccgcgcacacagcgcattcctggcgagtcggaggcagggtggggcccaggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacacctgaagcgcggattgtagatgaagaaactcagcagcgccggcgggaactgcttctcctgggccgcccaggacccgctcccggccccggccgtcgctgcgctgcagccatcctggcccggcccccacctcaggaagcctcccacggcccgcccagagaccgagaaaatctcttaatttcagtggaactcagtttgtttctctttttaaacattgccagttataaatgtattttatttta

SEQ ID NO: 1776 - DNA, 2306 bp, Homo sapiens
actttacggcgagattaagctcagggtcaagttctgagcaaaaagtgtcaaggagcctttttgcaacctcctataatattgaaacagattctgtgccctttaaaggagataataactaacatctggggagcgctttacaatttagaaaaggcctttcacacacaggcctgtttcatcttcacaacaatcttataaaacagatatattgttcccatttcccaaataatgaaacggaagcgccgaaaatatctcctatagggctcttcaaactgtggtcaacttagtaaatgatgttgacagtggaagtgtgatcattttattttcctgcctttggaattgaagattgtaattttgcaaaaattttgttgaagatgatgtagctttggttcagagagctggagtacaatggcaccatctcagctcgccgcaacctccacctcctgggttcaagcgattctcctgcctcagcctcccgagtagctgggattacaggttccaagtctcttcttcggcctctcaaacatggtaccatccctaatgaagtcaacgggtccagcatgacaggatggaagtacaagtgtcagcacctatgtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacagtcagttcatgattgaatctgtactctgtgtcttgcatccaaagggcatgaaggtctctggacctttcactatgtatagttcagggcagatatttgaatgcccactggtggatgggccactgcccacagctgtgggttagtacccagttctgacagatcttctgagtccctgacatactcttgttccttgtgtcacaaacgacagcactgtaagtagatgaaaatgcatttggagttgagtcgtttgtgctattcattttaatttttgtaaaattgcactaaaagaagaggaaatttcttcagctgcattgttttcaaaagacatcttaaatatgcatctttgagatcccaaggagggaccaaaagaaggcaagagagaaattctcttaaaaatgataaactgaaacatttcatttggttaagaaaaataatagacttcatttttagtacctccctagtttccaattttcttttttttaaatatatatattttttattgtactttaagttctagggtacatgtgcacaacgtgcaggtttgttacatatgtatacatgggccatgttggtgtgctgcatccagtaactcatcatttacattaggtatatctcctaatgctatccctcccccatacccccaccccacaacaggcccccgtgtgtgatgttccccttcctgtgtccaagtgttctcatttttcaattctcacctatgagtgagaacatgcggtgtttggttttttgtccttgtgatagtttgctgagaatgatggtttccagcttcacccatgtccctacaaaggacatgaactcattattttttatggctgcatagtattccatggtgcatttgtgccacattttcttaatccagtctatcattgttggacatttgggttggttccaagtctttgctattgtgagtagtgccacaataaacatacgtgtgcatgtgtctttatagcagcatgatttatattcctttgggtatatacctagtaatgggatggctgggtcaaatggtatttctagttctagatccctgaggaattgccacactgtcttccacaatggttgaactagtttacagtcccaccaacagtgtaaaagtgttcctatttctccacatcctccccagcacctgttgtttcctgactttttaatgatcctcattctaactggtgtgagatgatatctcattgtggttttgatttgcatttctctgatggccagtgatgatgcacattttttcatgtgcctgttggctgcataaatgtcttcttttg

SEQ ID NO: 1777 - DNA, 448 bp, Homo sapiens
gcccgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtat

SEQ ID NO: 1778 - DNA, 766 bp, Homo sapiens
ggcgcccgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaccaggccgccggcgccggctcgcggggacccgccaccctggaagccccgcgcacacagcgcattcctggcgagtcggaggcagggtggggcccaggtgtgggaaggagccgaggctgaggccgttcccttctccgcgggctctgtgggcggccgaggcccccacccgtcccgggaaccagttcctcccgggccctgcgcgtccgtccggggaagggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacct

SEQ ID NO: 1779 - DNA, 1652 bp, Homo sapiens
cggcttcctttttctccacacttctagctaccttgtttttatcgttttcggcacctgcccttccccagcgcccccaccaccccgagcactatgtatgatcgggctccccgcctgctcaaattggctgaaggtggcagcactgaggcccatgtgggtcctggatcctaccaggtacctttcctgaagcagcaggcgacaggtagtaatgcaccatttctttctttgactgccagagaaagtacttttaccattgcctctagcattgagaaagctgttccaggtccaggacactataatgtttcagaagcacagaaaatttcaagatcacctacacttaccagaagtgttgatgttccttcaattccttcttgtggaaagtcatatggttatcatattaatgatgatggcagtattataaaatgttttccacctgcttgtgacagtacacttggtccagcatactacaaacctcaatttgatgtttccaatgcaactttgaaatacaaaggtatacattttggcaactcttcaggaagacaagagttacctaaaaagtcaggtcctggtccaggacagtatgatatagtccagaaaaagacatcatattatgaaaatgttaacatcaagagagatcaacaacaaaattattgttcatttatcccacgactatatgaaataatagtattgcaggagaaaaaaaagagatttttacctatgaaatcaatcaccccggctcctggcacatataatgaacctcgaactgctctcaagtctttgaagaaaacatcaggactgaaaaatattccatttggtcaaagtgctgttcgattcacacaggacatcaggacagaggaaatgccaggtcctggattttataatgtcttgaacaatactataattgccagtgttagaaatatctgctcaaagaaacagaagaaaagtgcatttggttcttctgttcctcggactttcttctcggttcagaaagaagcttgtgctacccctggacctgctgattatcaggaattttggcattcacagggtgtgggaatttctgatgaattacctaacttgactaacaaatatgctgctttcttgtcaagagccaaaagaactatgaaagtaccagatatggttattccagcgccaggcagctatgatgttcacaaatcatatgagatgtcccaagttaagcataaatatatgccacctcgtagtttagtggctaaaagaaaacatgcctcttttcttagtgcaactcctcggtgcctagaaaaagtgactgatgggccaggtcctgcagcatacaatcctgttttaaggaaatcttgccccatacccttatttgtgaaagcatcaaagcgctttgaagagtccaaagagattactccaggcccagcaacatatgagatatcccaggagaaaaagaaaggaaatctcattggtgaaatggctgctgatataatgtgacataaatttatggcaaaaacttaaaaaacaacttcatggaagtcagtttatttctttgtcattttaacaaaatttattccaaatataggagtaataaaagcataattttcacttgttcaggcattcgctcaggctttagtgactatatgacacaaccacggagaaataaaccttgttaagac

SEQ ID NO: 1780 - DNA, 2165 bp, Homo sapiens
ctggccgccgagggtcgcggcgcccaggctgccggagccgccgccgtctgggctcggatccgggaagctgcggcgctgccgcggcagcggcgggcccctcatttgcatgcgattagcatgcgcccgcccgcctcatctgcatgcgcattcctcgcgccgcattcctgagcttaaccccgccgctgccggcgtcgccgcaccagctcggacgcactgccccgcggggccgcggctccaggtgggaggaaggcgggcgaaggaatgtgcggccagctccctccccttgaccccagatagctcccctgggccaaacgccgagaggttttagagtttctggacggggaagattgcaaaagtctccgcaaccttctcaacctctttcgtcttctagggaaaccacaaaactttcgagaggaaaggggtggcgggcggggagctctcctccggagaaaaaacctcaacaagcggagagggcacaaaggctccccacgccgcgccccgagcccctccggcaccccaagggcggtccggggtggtgggaaagcgccaagccctgggagtgcgtcggtgggtccgggacggcggggcctccgccagggctcctggccctcgatgacctcggctgagaccgcgagccgcgcggcggaaagcggaggaactcccgtccggccctgtagccgcccgcaccgcgccccgtcacccgccgccccttcgcgtccgggcgctccagccgcggggccccggaagctcctggtccctggcctcccctgcttggttcggggcggttggccgtggacgcgccccgactctagtcccttccgtccagccgcccgccccaggatgtccccccaccgcagccccgccgtggccaggaggtgtgggcggccacgccggagggacccacggcggcgccggacgcccgcccttcctaggccctggcccggccggggtgggccgggacgttccctgttgcataggcatttatttattcagcagctactacgtacgtgctggcccgcactgccgagggaccggacgcctgccccaggcgggacaatgccgggtgcagcgctggcggggcctggacgccaagcttcagggtccccagcccctcagtcagagggggcgcctcccaggccctggactcctctccagccgggtctacaccaccgtcccccgtcatcttcttctgggttactgagcagcttcttttaaaatagcaacaccgaggaaggccccgaagcccagtcttgcacctcgtggtgtgaagtcgtttaatcctgcccgctaatgcgtaaggactttccaccgtgtgcaggactccgcgctgggcaggggctctcgcagggtttgaaccgacctccgcctcccctgcgggttcacaggcctgcgaggaagtcgcgtgaaggagattcgctactgtgtgaggctggcctgcgcggcgtgggcagtagctgtccggggctggggacagctttcggctccccaggccatcccgtcggggcatctgcggccaatctcgaaggtggagaggctcagggttggaacagacttcacggaaggggtcctagaagaggaaaggggtcgtgtttgcccttagagcagtctgggcgtgaagcggaaactttaaaccaccagaaactctggagagcttggagcacctgggaaggagcaaccagagtgggccggaggtagggaaggaaggcacccacggcgaatttgcccgctttgaccgcatttagggcggccgcttgtgcagccagccttctggaaggtaggctttgcgcttggtgaagagaagcccccacctccggatctgtgttccgccccagtccattcatcaggaggtgatcacacaagtcaagcttctctagttcccggtggaatgagacgccctggtggggtcttaaggttgaacgtttgaatactgtaaaaaagatgggacctgcctacaattaatctctcacactactgagcgaatgtgcgttgttttggacttccctaaattggcccaaatgcatagccaacacttgaattgcggtgtactaacaacatcattcagcaccaaaccaaaccattcttatttaaaccttgcttcctagcttatttatttcccaaacaacttgaaaacatttgttatactaaaatgtctacatcttactatt

SEQ ID NO: 1781 - DNA, 2175 bp, Homo sapiens
gcttcgacttccgggtgagaccgtgaaggtgtggcgcgacgttggagaccggggcagcgccatgtaccacagtggatggaaggatgcgcggtgcggcggggcagctgtcctcttctccccggacccagcgcctggagagccagccctgcagggtgggctgggcgagccaaactgcgttcctggtgcagggcttcgggtctccctaacagaccttatacgctgaccggcggccgccatggcagtgtctctttgctcagacatccagggacgaccacattcgtccaacagcggtcgctccaccaatcctgggagaagcgaatcgttttctccgcgtgccctgtcagccgctcatggtgcccagagaggaattttagtggcagcattccggctgtcacgccaccgaaattgccaggccactccaagtcagaaggaccaccaggaaaagtcaggaagagaaccaccatcaggtcccagcctctttttgtgacaaggactagagggtttgggtctgcagtgggctggctcccgctgggctcacctgtcctatagagcaggctgcctcaaggaagaagctcacaggggacatctgacatctgaaacagcaagtgtaaaatgctttaaataagccaaaactaaaccaatcgttatgttaactaaaaatacatgaatgctaccgaagatagtcgaatattagaggaagagattaaactctgattttgagcactttgtgctttattcggaaaatgaataagatgcagttctgaaaacctgaaaatataaagaataggatatgatacgcacactagatgaaaacaaaactttcagaccatattttcttatttaaagctctaataagtgagatagcagagtaaactattcactcaaataattagtaactgatataagggtatgtatcaataacaggtattaagacaaaaactttatgagcttttccattttaacaagggatgatgattctagacttctgccacaacattatggtcgacaaaacattcttaattcattttacatagatctgactctagattctgaaacagcaagtcataatcttgtatctctaaagatagaatacagtgcgatttggaaagacaccacaaaaactcatgatccaaaaaagattaaggctgttattaccaggaggaagagaaagaggacaaaatcaaactggatagatataatagagttgtttgttagaattgtcttcccaggagatggaaaaagacgccatcacaataggattcatgctttagttttcagctatagaaatgtaataactttgccaaagtaattacactacatagagtggcaatcgttctattaaaagtaagacccagtaatgttaggatttgttctggacaatgaaggggatgaggtttaatcttatgacttgaatgccaggtctgaaatcttttcttcaagtgatatttttatgaaactacttaggctgtgtttcacactgggtatgatttctaacctcttataacctgtacagtaatagattatgaaggatgaattatttgaaagctattttgtattatttaggagaggagctcttcaattctgaattgtctgccacttacaagcagaagaaagtttttttctttcattattttagcaactatcaataaaacagtattagaaatgcctactcttcagagatgtaatgggaataaattgtaaagtacttttgatattctaagatgaaagatggtattacacagtcaataattcaatgcttcccacattatgaattttatcaaaattatgtagagagctattagttcattccagcaacaaaacaggcttatataaaaacaaaaacctcctgggtcatgccatcctacaccaaattcctgttaaacagaggcatgatttattccagtgaccttgctatttcttcataactgtaatatgtctaatgttagacattttaaattaacattctattagataaactgagaatttaggtctctcgcaccacccaggcacatactctatctttccccacaaatatccaaatatggtaatataattggattaatacgttcatatgactatataattgttcacagctgagccacttaggtgctataattataatttctttgatacacaaattttgttttattgtgattaaaattgcctgatttctta

SEQ ID NO: 1782 - DNA, 911 bp, Homo sapiens
aaggggtcgtagctggaggggcctaggtgaggctgccgggaagggacgatgtggttggtggagtgcacaggcagggacctcactggactttcctgtctgctcagcatggacaggcagcccaggagaaggcagcacgtggccgggtgcagggacgtaccacccccacttccccaggggagctggggtcagacgagtcccaggcactccatcctctgcagcaagtcaggttgtgatttactagggggtggtgaatataatggagagacttctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgc

SEQ ID NO: 1783 - DNA, 1978 bp, Homo sapiens
tctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatccccaaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactattataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 1784 - DNA, 2922 bp, Homo sapiens
agggcttcctagaggaggtaggccttctagtcactccttcatctgcaggcactccacagagctctctgtgccagcccccagcacggagggctgaccttagtcgagtggagatgccccagtgccaggcagtagggatgatgtctcctgaggcccagatggaagggactggactagtctcatggggctgatggtggggccaggccttgaccagggacccagtgtagggggtgcagagacccctctgagttcctcacacatccctggggccctccccatacacttcctatcctgactgcgggcaagagggagccccagttcgccttccctatgctgggcacccacagtggggctgggcacccccgccatgcccctgccctgtccttcccctgagagcctcggtcccacctccaaggtgcctcagaggacagcaggggcagcgggcagaggccgagatgcctcctcattccaggctcagctgcccttcttggggcagcccacacctgagagtctcctgcagttggtcaggcctgaggagggcaggggggtgcctgctgtccctctgctgaccacagtggcatttagcctgggcaccgcgcccagcacagtccatgctgcacaggtgccgtgggctccacagagccctgcctgacatgcatgtgttacgtttcgggtgccgatgcccttgggcggcacttctccgggcagaacccccaggccaccgctccggttccggttccgctgcatctggggctctcggcaggctgtggtcctccggccagcctgggggcatctcagtccctcagccccacaggggcctgccccgcagcctgggcctcgagccccgtctccgcacgctgtgccgaatctggctgcccatcagctccctgcgtacccagactgtgccctgccatgcccgtggctcttcccaggagtgccctgtggcctccccctggcttgctgggctgattccctcctgtgtctcaaacagagctcacctttgccatcactgctgtcctcaccggccggtgccagaggcccgtgtctgtgtaccctgtgtctgcacctctgggcagggcctggctctgaccaacccgggcttccagtgtccacagacctaaggcccagggcgcctgggggctggagcaagagaagcaaaaggagccaagggtgggggtttggggttcttgtgagggcccagccccaggaccccaggaccaggacacccaggagccccagggcccagccccagttcagaaggcaggggccttctgagggagcttaagggtcccacagcccaggacccccaccagggccagtggccagcgttgggggactcagcctcctcgtcgctcgtcctctctgtttctcccaccttttgccccctttctccttgcctgttcccacccgaggccccctcttggcctgcgtgagccggggcggcactgaactgggggccgatccgcctgggcggcggtgagaggcagggccgggagccgggccgctgggtttgggcctggcccgctcgccgcaatattgatggcccgtcagtgcagccctgattcctgtgctttcagttaaaaggtttctgttgttgtagcttatgcagttgctctgttgctatggaaacgtgacatcaaaatgacgtttcccgtttaaaagcttttaactaaattcctgcctgtcagatgtaggccccattttgagcgtggagctgccttcgagcgagcgtgagcggcgcctcccgcccatggtgcgtggggccgggccggggccctcgctgagcgcgctctctcaccccacaggcgcctccggcatggcggcggccgaggggcccggctacctcgtgtctccccaggcggagaagcaccggcgggcccgcaactggacggacgccgagatgcgcggcctcatgctggtctgggaggagttcttcgacgagctcaagcagaccaagcgcaacgccaaggtgtacgagaagatggccagcaagctcttcgagatgaccggcgagcgcaggctgggcgaggagatcaagatcaagatcaccaacatgaccttccagtacaggaaattaaaatgcatgacagatagcgagtccgccccgcccgactggccctattacctagccattgatgggattctggccaaggtccccgagtcctgtgatggcaaactgccggacagccagccgccggggccctccacgtcccagaccgaggcgtccctgtcgccgcccgctaagtccacccctctgtacttcccgtataaccagtgctcctacgaaggccgcttcgaggatgatcgctccgacagctcctccagcttactgtcccttaagttcaggtcggaggagcggccggtgaagaagcgcaaggtgcagagctgccacctgcagaagaagcagctgcggctgctggaggccatggtggaggagcagcgccggctgagccgcgccgtggaggagacctgccgcgaggtgcgccgcgtgctggaccagcagcacatcctgcaggtgcagagcctgcagctgcaggagcgcatgatgagtctgctggagaggatcatcaccaagtccagcgtctaggccagcaggcggcggcggcggcggggccgggcggctggtggtactgctcaggccacccagggcaggccactcaggccaggcgggcaagggggccgccccgcgagcggagaccgccttccacctggcctctggcaggatgtcccttctgaggggtattttgaggaacccccaggccctggggaccgtgaggctccagtctccagcatgaatgcccttcctcggacacaggccagggcctctggggttcactccgagtaagaacgtcctagagccactctccagtgtcgttactatcaatgatacttgacgtggctttgatattaaacgtatactttttc

SEQ ID NO: 1785 - DNA, 1215 bp, Homo sapiens
agagtctttcgttctttctggtgcagcttaactgatttgaagaagccgaagaagaaaatccagtagcacggttaagactttagccatggcatctgtatcataccaaaagccaacatctactactgtgggaaaacaaatgatttttacaggtccagactacataaaggattatttacccaaaattcatcagcacacctcctatgtaggagaacagcatctggcgttagaaaaaactggagatctcagatatttatggaggcctgcctcaaatagaagcttgccagcaaaatataaacatgagtacgtcagtgaaattggttggagaataccacagtataattttatcaacaaatcaagactggggagtggctttcatatcaagtatgaagaactaagtcaagcttctcttgattcaataacccacagatatcaaaacccatggcaaccaaaacctcatgtcctggatatgcaaggaaaacagagtcgcgcttcttttgcctggcatatgagtgctttcgaggacactgatcagagaaattccaaatgggctattcttgttaggcagtgtaagtcatcattgccaagagcttccaaaccacctaagctgccgaagctaccaaaaaaggaaaagaaaaggaaacattaacctctaaatcagcataactcaacctgcttttagaaggagaaactgcctactactgtataacaaaaaataagatcataataatccacaagtgcttctcatattgccccaggacagatgtcttgcaagagtacgcttcagcttaaagcccaaataaacagtttggaaaaaaggtgttgtcagtctttgcaaccattaatattgtttcatgaaactaattgttattgactatcatactaatagtagctgtttactgagtgcttataacatctaacactattccaagtgctttacattcattctctaatataatttcataaccataggagataggttctattatttccccagctttgcagataaggaaattaaggctttgaaagagtacatggttaggaagtagcagaacttggatttgaccccaggttatggggctctaaagctaacatatatggcttttaaagtattttataatattggcatggtgctttagcagtaaaaagcagttatatccctaattttcagaagattctcacagcacccttgttgaacaggtactatctttcttttac

SEQ ID NO: 1786 - DNA, 3521 bp, Homo sapiens
gcccttcgagatcgattggaggctcgcgcaggagccgtgagttgcctaaggtgaattgactcatatgattggctgtcccgaaaaatgaaacgtctttgtggtccggggctgagacccacgaggagactgggcgggatttctggcgttaggaggcggggcctttcggctttgggcgcgagtggttaaaagacagttggtgtcggttcggcttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgattttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgattttttttgtattatttgatcttagtgacagtgttctattttgcatcctgtatcttatgttgcttttggtgttttgtgttgtgtgtcaacgattaagccaactaattctctaccatatataacttctggacatttttgatacaacatcttaattctttgtagatatggagataggtacagaactatattctaatgccccacaatggggctatgagaggggacagatggatgggcaaagaatagttttgtttaacatattaggtcatagttcttgattagtttttttagttaaagataaacacatagggtgtgatttctataccaaagatatgcttatttcagtattagaaaaatattcttcttacatctcctgaaaattgcaatttttaaaatgtgtaaaaataaattattattaaaagcacattttatttccatttgtttggattcattaccttaaaactttattgacatatttcaaagatataggaaaggtaaatgatttcaagaaaatccgtgtatttctaccatgcagatgtaataaatgttagcatttggctatattttcttcagacacacatatgcatgtaattgcaaatgttagatacatttgaagtttgctttgttacctgtttgatcctgtcccgttcctccctccccagagtccccagaggtaaccactagagggggcataatatagcatgtgtttttatatttttaatacaaatatattttttaaaagcgctacaaaatattgttttatatatgtggtagccagcttccagatggccccagtgatccctggcctcctggtgttcatgccccagtatagccttctcctgcattttacagtgctgacttttgtaactaccaggatattgagcaaatgcagtgtgtgatttctgaggccatatcttttactcttttttttttttttaagagacaagatctcactctattgctcaggctggagtgtggtggcaggatcatagctcactgtaaccttaaacttggactcaaacaatcctcccatctcgcctcctcctataaagcactgggattacaggcatttttgctcatttttctatgttgttttttttacttgtcagtttttagatattacatattttgaatactaatgatctgttatgtatgttccaattatcttttttagtctggtttgtcttcatattttggttatgaaatcttgaatttttaaaaacgtaattttaccaatctttcataatgatttgctttttctggtttttgtataggaaatgtcataaaaatagtcctattcagccttccaaaagttacaaaatttttgtttttaacatttagatgtttagtccaactgaaatttgttttcttttatggcatgattttggaatcttgttttaattatttttacatatttatagctgttcctccaagtatcaatttttcaagtgcaacatctgtcatgcagttactatgtaagggccagattctgacctttctgttctttttatctgaaggaaatttgaacatgccacccccaaatatgccgatttggcatactgattatttcgagctaaaggtgcttgactaacagtagttgcagaaatggctattttaactgtcctttcctacctgtagcaagccatacaaacttctttgataaagatgctttcctgataccaagatgagaagatggctctaatcagctgagacagcaccagaggaatctacaaacaagaaactattagtttcttaacatatatttaccttccacagtttctgcctctggaagcctaaaactgctttccttcgtcttgtcacacttctctgaaatgtattctttgtggaagatgctatatagtccagagttgtaagccactacttgtgtttaccttttcattgagttttctcctgtgtgatgtacgttgcatatattaataaaattacttgtttttctcttg

SEQ ID NO: 1787 - DNA, 1134 bp, Homo sapiens
agtaccaccaccagacgccaccatgcctgcggaaggaggaaaaacggacatggaaaggattggcctctttagtgagatggaatatattactgtgggtgataaatatgtgtcacaatttaatcgaccctttaatgaggctgcaagcaaaaataaacagatgctacctggagggtccaaagaaatgtcagatcttcaggcaggttattttgatccccattttgtaaggatttttgaaggtgaaggctacataaatctgaatcaagtgaggagacgggatatggtggaagcagccaaaaaaaatctaggcaaagcattcctccctagtaatggagagaaaaagccatgtggcttaggaagctactatggaacaataggtggtccagtcccatttttcagcgcacagtcaaaacctcgagaaaaatacaaggcacctggaaagaatttatacacaaacccgggaaagaaaggaactggatatggctatgcaaatattaccataggtaaacagttttcacactctgccgacttctatgatgcagcaaaactaaagtataagaaagcgaatgaagagcaccatcgtttacttaaaggagcaccatttaagttaaatcttcacccaagggactattttgacgctaatccttatttttctgaggaatctttaccaccaattaaaaaagaagagaagaagaaaacaatttcaaatacttttaaaccgtcttctcctggtaaaaagcctggtggaatgaaggcaggaacatttgatccttacccatcacattctgctgacccttatgtggctaaattggcaaatatttctggcaaagatgataagattttccacccaccaagtggaccaaaaagcagaccagttgaaagtataatgactttgaatgtcagaagggcactaaattcaaagaactacaagacttcttcagtaccatcctattagcaactggaagacaagtagctttctagatcttaactatgagtaattcactatcaagagctaattatttgaaaaaatataagatgttatggagcagatagctcaagcagttaaaagaaattctgcaactctaattctcttccttattttaatactactagttaataaatagtatttgctaataa

SEQ ID NO: 1788 - DNA, 714 bp, Homo sapiens
cgtgcagaggcgctgcgcagcccaggcgtgtcgcgcgcttgggaaccctcgccgctcccgcagcgcagttaacgtggacaagctggggcaacctggacgagctggggcaacctgatctcggctgtcggagtgggtgtcctcaagaaagtaggactttgctataaaacacgtgaccctagggaaacttttgaagttagcggtatagagagtaccaccaccagacgccaccatgcctgcggaaggaggaaaaacggacatggaaaggattggcctctttagtgagatggaatatattactgtgggtgataaatatgtgtcacaatttaatcgaccctttaatgaggctgcaagcaaaaataaacagatgctacctggagggtccaaagaaatgtcagatcttcaggcaggttattttgatccccattttgtaaggatttttgaaggtgaaggctacataaatctgaatcaagtgaggagacgggatatggtggaagcagccaaaaaaaatctaggcaaagcattcctccctagtaatggagagaaaaagccatgtggcttaggaagctactatggaacaataggtggtccagtcccatttttcagcgcacagtcaaaacctcgagaaaaatacaaggcacctggaaagaatttatacacaaacccgggaaagaaaggaactggatatggctatgcaaatattaccataggtaaaca

SEQ ID NO: 1789 - DNA, 785 bp, Homo sapiens
cgtgcagaggcgctgcgcagcccaggcgtgtcgcgcgcttgggaaccctcgccgctcccgcagcgcagttaacgtggacaagctggggcaacctggacgagctggggcaacctgatctcggctgtcggagtgggtgtcctcaagaaaggtgacttggtcctcgcggacgccaggactttgctataaaacacgtgaccctagggaaacttttgaagttagcggtatagagagtaccaccaccagacgccaccatgcctgcggaaggaggaaaaacggacatggaaaggattggcctctttagtgagatggaatatattactgtgggtgataaatatgtgtcacaatttaatcgaccctttaatgaggctgcaagcaaaaataaacagatgctacctggagggtccaaagaaatgtcagatcttcaggcaggttattttgatccccattttgtaaggatttttgaaggtgaaggctacataaatctgaatcaagtgaggagacgggatatggtggaagcagccaaaaaaaatctaggcaaagcattcctccctagtaatggagagaaaaagccatgtggcttaggaagctactatggaacaataggtggtccagtcccatttttcagcgcacagtcaaaacctcgagaaaaatacaaggcacctggaaagaatttatacacaaacccgggaaagaaaggaactggatatggctatgcaaatattaccataggtaaacagttttcacactctgccgacttctatgatgcagcaaaactaaagtataag

SEQ ID NO: 1790 - DNA, 3178 bp, Homo sapiens
gtgaaagaagcacatttggagaaagaggagaagaggcccaggtgttctgtggctcaggggcaagctctgagctccctgagcaatggccccatgctccgggactcagaggccgaggttactgaggaggatcccaggctgcgggcccagcagctccatcaccgggtgctgaccctgcagtgccagctcagggaccagggcgctgcccaccaggcgtctctggacgaggccacccgcctccaggaggagctccaggccaagcttgaagaacttcagaaaaagcaacatgaagcaaagttggcagtgactcccctgaaggccaagatagcttccctcgtccggaagtgccgggagaggaaccgcctgatcacccacctgctgcaggagctgcacagacatgggctggggaacctcctgctctccgagctggcgcagaacatgctcaacgacgtggcactggctgagtacacggccaccttcctggctccgggagtcccagagacaagccaccacctggacgtcaagtctgagatgacggcagctttaagagctcagacatacctcttgaatcctgaaatggacagtgtcctccaaagctcattgtcttcagagtcctggcctattcccgagccggagtggccagcacagacagcccaactggattctctgaagctccctctgtccttggtgtccacgcttgatcctggaacgtgcctggcagcggtcactgtggaaccaggtctccccgcacaacgtctgcaagaaaaaggcggaatgccctgtcctgccctccaagtcgataacgtcccagcaccctctgagctcctgagcccagcaaggatcctggcttttcaccaagagcttagacaaagcatttgcagcaattcccaggtccataaatcaccgctggagttagaaatgtaatagggccactcattctccggagccatttcatagactccataaatatttgaagcagaaccttcagagagtgctttaagaaattggtagcaatcagagccctcatttagtggcaagtggttttgccttcggctttgggattttgtgttcattgtcagagcttgagagaaacgctggcctgtgcctggcaaattctgaggagtttggctttggcaatgtcaaggcagcataggaaatatttactgtaccaaaacctattgaatgattggtccagaggttctcaactgggcacagttttagccccccagggaaaatctggccatgtctggagacatttttggttgtcacagctgggacactgctactggcatctggtgggtagaggccagggatgctatgaaatgtcctacaatacccaggccagcctcctacagcaaagaattacagcccgagggtcgccagtgctgaggtcgagagtccaggacggatctcatagctcccaacaagatcagccatggagaattgttttgttttgttttttctctgcccccggggtccttcccatgttttaaaagattttttgtctactaagtgaaacgcctaagtcaccatatattttacatttaaaaacattaaaactaaccagaactttctaatcagtccatccactccaaaaacgtctgttgatatccactggatgccaggcaatgtggcatgaaggagaagagacaagtcaatgttgatcctggcgccggggacctcacaggacaatgggagagatactcctgtgagtaaatcagcacgcacgcaagtgtcacatgtgccctgagcaacgggatgaaggtaagggtccgttctacttggcttgggacaactggaagtcagccacaaaggaatggctgggcagtgtccggtgggtgaggtgggaagggtgctgctgtacgagggaacgcatgtgcaaaggccctgaggcataaaactgaactgtggatgtgcccctggaggggaagtgggcaaagcatgctcttgtcaagccagctgcaagcagtcactgcatcgttcccatccagcaccccttccttccaccgagaacagagactcgtgccccgaatcaggtgggcgacccaggagaagagcacttctatcctgagggcagccccccaaaaagagagtctagggggcttggacgacacacaccagaccctgacccaggctcacccaccagagatgtcacctctctctttgggaaggggctgaggaggggcttaagggaaaggccaaagccgctacctgtccaattctgtcctctcctggaagtgactgtcccttcatggaaggacaaacaaggacaaggacaaggaactgacggctccccaggaagtgtcaaagtgtatagatttattttaacgtagtttagctttttgtttgaaatgaaaattacacagagttcccgtagactcttccccgggcttcccttgatgttaacatctcatgtgacttatgttgtacaattatagaaactagtgggttttatttcgaggaaaattggggagccattgagacgtaagaaaggcagcctcagcacattgagttccaccctttaaattcgtttatggggttttctgatgggttagcacattcatccatgtattcctggattgatttacccacagatctgtctatttatttatttattcaatatgcatttagtgactgctgtgcgagtgtctggctggatgctgctggggaagaagtgaagatgatgctgtccacctaggttttcagggacccccctggagaccctgtggccccgttaccacccctcaagaatccccagattggaaaccactgcggtgatccctttgttggttcaaccaccccagggcttccctataatttccaagcaggaagtgacctgcagcactggtttggtgatccgccttctgcctccctctgtattttgggacaatgtcattagctttgagcatcaggaacatgacagagagaggacagaaacccggtgcagccgaggacagccagctgagcccttgctgagccagcgagatgcagcgtggtgccaccacatctggtctccaggagtcccaggagctcagacgtccgtcgtcttgtgacttcatgctcccctctgccgcgctcacgtgctgggcctgggcagaaaggcaacccaggaaatccattaaagcaagccaagacgacctttgcagcgtaacccaacgattccctaataaatcatgtttcc

SEQ ID NO: 1791 - DNA, 4557 bp, Homo sapiens
ggggtgcccccgaggagcctgactcccaggaacatgagagcaaggaaatgcttttctttgcaggagagacaggtttgccactgtttcccagatttgccttatcagttgaaggggccgaacccactgatcatggtcatccacaggctgtgagcaaaggacacaacaggtgtgcactcacaatcgatgagcttgcacaggacgtggaggcttgtttccagcagctgtccaccctgcagccgggcagcaggggctggcagtgctcagcctctgcatgtaggggagagaactggagctttgctcagaagtggcacagtggctgggagagagctcactctcagcaggtttggggaaattggggtatttgttctaatgaagaagcgaagtctaaagagagtggtgaaggtgataagccgggaaagaccacggccctgggcaccagcgaagttcctggtaacccagggacactgcctcattgggatgaagccagcccaaaccctccacaggggcctgctgagccctggggtgccctcgagagagtgaggagcaggtttcatcagctcatttctggattgaagaaacagagaagccagattttacatgacaacaccaaacttcacggagaccaagagaggttccatgaaagagtgtgcgcccttgaaagagagagagagagagaggtgacaaaaatatccaggctcgagcgggataaccacaggctggtaggggacatctctcagttaaagaaagaactggatcaatatttacaggcaatctctgaccttgaagactgcaatgggaagagttactgcaaaattttggagcttgaagaggaaaatgaaacactgaaagggaatctgggccaactccagaaagccacgtctgagagtgtcaggaaatccaaagacacgatggagcaagtcaccctggaaaactggaagctccagacactgatctcggagcttggcgtcagttataaagagctgataaaggatatcgtgctaggaatagaagacatgatccgggccttaagtggggagaacgagcaccttctacgcagggtccatgtcctggagagggaagtcaccttgcagaggagcacggatcaggggcgtttggtgaggggaagggagcacctccagggaaaagccaagatgcacgctctagacaaagaggtgcaggtgactccactcacaggacagctgctttcaagagcctgtgggccacccttggaggaggaaatgagtctggctgcagggcagacaggaccttccacaggcaccgggaattccagacgcggtgctgattctccccctccatcgctggtctggagaaacactggtgtagccaatgccctgcaaggaaatgtcagtggagcagaagtgaaagaagcacatttggagaaagaggagaagaggcccaggtgttctgtggctcaggggcaagctctgagctccctgagcaatggccccatgctccgggactcagaggccgaggttactgaggaggatcccaggctgcgggcccagcagctccatcaccgggtgctgaccctgcagtgccagctcagggaccagggcgctgcccaccaggcgtctctggacgaggccacccgcctccaggaggagctccaggccaagcttgaagaacttcagaaaaagcaacatgaagcaaagttggcagtgactcccctgaaggccaagatagcttccctcgtccggaagtgccgggagaggaaccgcctgatcacccacctgctgcaggagctgcacagacatgggctggggaacctcctgctctccgagctggcgcagaacatgctcaacgacgtggcactggctgagtacacggccaccttcctggctccgggagtcccagagacaagccaccacctggacgtcaagtctgagatgacggcagctttaagagctcagacatacctcttgaatcctgaaatggacagtgtcctccaaagctcattgtcttcagagtcctggcctattcccgagccggagtggccagcacagacagcccaactggattctctgaagctccctctgtccttggtgtccacgcttgatcctggaacgtgcctggcagcggtcactgtggaaccaggtctccccgcacaacgtctgcaagaaaaaggcggaatgccctgtcctgccctccaagtcgataacgtcccagcaccctctgagctcctgagcccagcaaggatcctggcttttcaccaagagcttagacaaagcatttgcagcaattcccaggtccataaatcaccgctggagttagaaatgtaatagggccactcattctccggagccatttcatagactccataaatatttgaagcagaaccttcagagagtgctttaagaaattggtagcaatcagagccctcatttagtggcaagtggttttgccttcggctttgggattttgtgttcattgtcagagcttgagagaaacgctggcctgtgcctggcaaattctgaggagtttggctttggcaatgtcaaggcagcataggaaatatttactgtaccaaaacctattgaatgattggtccagaggttctcaactgggcacagttttagccccccagggaaaatctggccatgtctggagacatttttggttgtcacagctgggacactgctactggcatctggtgggtagaggccagggatgctatgaaatgtcctacaatacccaggccagcctcctacagcaaagaattacagcccgagggtcgccagtgctgaggtcgagagtccaggacggatctcatagctcccaacaagatcagccatggagaattgttttgttttgttttttctctgcccccggggtccttcccatgttttaaaagattttttgtctactaagtgaaacgcctaagtcaccatatattttacatttaaaaacattaaaactaaccagaactttctaatcagtccatccactccaaaaacgtctgttgatatccactggatgccaggcaatgtggcatgaaggagaagagacaagtcaatgttgatcctggcgccggggacctcacaggacaatgggagagatactcctgtgagtaaatcagcacgcacgcaagtgtcacatgtgccctgagcaacgggatgaaggtaagggtccgttctacttggcttgggacaactggaagtcagccacaaaggaatggctgggcagtgtccggtgggtgaggtgggaagggtgctgctgtacgagggaacgcatgtgcaaaggccctgaggcataaaactgaactgtggatgtgcccctggaggggaagtgggcaaagcatgctcttgtcaagccagctgcaagcagtcactgcatcgttcccatccagcaccccttccttccaccgagaacagagactcgtgccccgaatcaggtgggcgacccaggagaagagcacttctatcctgagggcagccccccaaaaagagagtctagggggcttggacgacacacaccagaccctgacccaggctcacccaccagagatgtcacctctctctttgggaaggggctgaggaggggcttaagggaaaggccaaagccgctacctgtccaattctgtcctctcctggaagtgactgtcccttcatggaaggacaaacaaggacaaggacaaggaactgacggctccccaggaagtgtcaaagtgtatagatttattttaacgtagtttagctttttgtttgaaatgaaaattacacagagttcccgtagactcttccccgggcttcccttgatgttaacatctcatgtgacttatgttgtacaattatagaaactagtgggttttatttcgaggaaaattggggagccattgagacgtaagaaaggcagcctcagcacattgagttccaccctttaaattcgtttatggggttttctgatgggttagcacattcatccatgtattcctggattgatttacccacagatctgtctatttatttatttattcaatatgcatttagtgactgctgtgcgagtgtctggctggatgctgctggggaagaagtgaagatgatgctgtccacctaggttttcagggacccccctggagaccctgtggccccgttaccacccctcaagaatccccagattggaaaccactgcggtgatccctttgttggttcaaccaccccagggcttccctataatttccaagcaggaagtgacctgcagcactggtttggtgatccgccttctgcctccctctgtattttgggacaatgtcattagctttgagcatcaggaacatgacagagagaggacagaaacccggtgcagccgaggacagccagctgagcccttgctgagccagcgagatgcagcgtggtgccaccacatctggtctccaggagtcccaggagctcagacgtccgtcgtcttgtgacttcatgctcccctctgccgcgctcacgtgctgggcctgggcagaaaggcaacccaggaaatccattaaagcaagccaagacgacctttgcagcgtaacccaacgattccctaataaatcatgtttcc

SEQ ID NO: 1792 - DNA, 846 bp, Homo sapiens
atgtcacactacttctacttgactccacaaattcttctgccctttagccctcttacttctcaagagtttgatctgatcagacgcaaggctggagcatcttggcaggatgaaacacgatggtcagattcttccgtgacaacatacacaggcagttaccggaaaaaacaactggacaagtccatgtgcagccaattttcttttagagcaggacagcatgagcctgagtgtaaacagatgtcattgacaaacagttctgcctgtcatcttctctgctgggctggtacccaagagactacagatatcaaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactgagttggaaaatgaagccacaaggctggaggcgtggagtttgcttaataaacaactttgaggtatggggccctcccaacaccctccccccacccgccccgcccaggaacgtctggaccctggcaggttggctttctgggacaattccatgggcttcatttatcagttttttccctttttaattggtggagagagacaaaagtttttataatctttattaaattttcctttttaaataaa

SEQ ID NO: 1793 - DNA, 722 bp, Homo sapiens
cagattcttccgtgacaacatacacaggcagttaccggaaaaaacaactggacaagtccatgtgcagccaattttcttttagagcaggacagcatgagcctgagtgtaaacagatgtcattgacaaacagttctgcctgtcatcttctctgctgggctggtacccaagagactacagatatcaaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactgagttggaaaatgaagccacaaggctggaggcgtggagtttgcttaataaacaactttgaggtatggggccctcccaacaccctccccccacccgccccgcccaggaacgtctggaccctggcaggttggctttctgggacaattccatgggcttcatttatcagttttttccctttttaattggtggagagagacaaaagtttttataatctttattaaattttcctttttaaat

SEQ ID NO: 1794 - DNA, 1127 bp, Homo sapiens
atggtaaaggaggtctggagggtgctgagggaggaaccgggccgaaggaaggaaagtagacagaacagggcccgcgggaatcgagtgcagcaaaacagctccaacctcaatccaacgccagcgcccggcccgcacagcacggaatcccggggaaggcggagggcggggtccgaggccccgcctgtgcccggaagcgaaagcctctccacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccgtgttggaaaataaatatgaagcaagtcaaactagatgcatacacttgtgtagaaatcaataatcaattaatagaagtgaaaaaatagacattaaaatgatttatttct

SEQ ID NO: 1795 - DNA, 935 bp, Homo sapiens
gcgaaagcctctccacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccgtgttggaaaataaatatgaagcaagtcaaactagatgcatacacttgtgtagaaatcaataatcaattaatagaagtgaaaaaatagacattaaaatgatttatttcta

SEQ ID NO: 1796 - DNA, 873 bp, Homo sapiens
ctgtttcaaccatatcctttcaaaccagatcagtgaggtcatgaccagaaaacaagccctgccagcctcctacctcaaatctaattaattataattttcttccttatgacaacccacacaaaagacagagataagaaaaacaaggacttcctgggaggctgtggatcaattaccaatggacacccagaagcaaattcacaagactcacaattcaaagaaccaattttttacaattttttttttcctgtcagttgaatttgggaaggaaggaacacgcaaaaatttttaccttcttctttcaattggacactatggacggaaatccaggagagctgaccttggaactgcagacactgcagataaaacagagccagaatgctttgctgccagctggacctttgacccaaaccccagtgtgactgtctccggtgctcactcaactgcagtgcatcaatgaaggaaaaaagaactgagcattggcaaaaagctgaggatgacaagcttaggggatgaaaggctgccttttcccccccttctgagcgtttctgacagctcccagctgggagaaaccaacatgacgaaaagacaaagaatactggagaagagagagggtgggcagagccacaacctcatcctcccagtggttcctcttgagtttgatttgacaagatgccttcccacccaggtaaccccgtgggaacgtgccagtacctcaccgcacgacctcactgagtcctcacaacaaatccaggctgcagatttttttccccacttggagatgacaaattgaaatgcaggaaggttaaagagtttgcctgaggttgcttagataataaaagaatctggattagaacccagacctacccagctaaa

SEQ ID NO: 1797 - DNA, 477 bp, Homo sapiens
atgcctgagcctcccaccccctccgttggctcctgtgctgcccgagcctcccggatgagcgccgccccctgctccagggcgcccagtcccatcgaccacccaagggctgaggagtgcgggcgcgcggcgcgggactggcaggcagctccacctgcagccccggtgagggatccactgggtgaagccagctgggctcctgagtctggtgaggacatggagaacctttatgtccagctcaagttgcagtccgtaggcacttgctttaaccgtgaagaattaccttcagtacttcagggtgaggaattgggagccaccagtgtgacaaataaacctggactctcagcaatgaggaaagaaacagaccaacaagttggggaaagaaagctcacatactgcggtgaccaggtaactctgttcacagaccaagccctcagtcaaatactatcttctgaggagggaagaatcaaggttatgtag

SEQ ID NO: 1798 - DNA, 3612 bp, Homo sapiens
aatccgaaaacgcaaccgggtgagggagcgcttccgcccggagagagctggccgggatgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcagggttacaagtacagatcattatttcctaagtgatggtctgtatgtacctgaagaccagctagagaaccaaaaacctttacaattggatgtaattatggtaaaaccttataaactctgtaacaatcaagaagaaaacgatgcagtgtcttctgctaagaaaccaaagctagccctggaagattcggaaaacactgcctctactaactgtgactcttcttcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgttgtatcttggtttagtaacaggcccttaattaacttatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatctttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtctcttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttgaaaagaatcaacttagtaaattatgtcttgcacattccaaataggaaggtatttactttatcaagatgtgtttcatttgtgttctgagtaccagtgaggggataccgtggtacagtgttttgaattgtgtactaatatcattaaagcatgggattttagtggctttttaaaaaatgtga

SEQ ID NO: 1799 - DNA, 3799 bp, Homo sapiens
aatccgaaaacgcaaccgggtgagggagcgcttccgcccggagagagctggccgggatgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcagggttacaagtacagatcattatttcctaagtgatggtctgtatgtacctgaagaccagctagagaaccaaaaacctttacaattggatgtaattatggtaaaaccttataaactctgtaacaatcaagaagaaaacgatgcagtgtcttctgctaagaaaccaaagctagccctggaagattcggaaaacactgcctctactaactgtgactcttcttcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatgttcccagcaagttcttcatctccatctgagaccacctcagcctggatttcattgtccatgtcattatcagcattttggtccaagccattcaacaagtctctaggaagttccaaactgtccaacatttccctgccttcttctgagccctccaaactgttccaacctctgccagttccaaagttgcttccacattttcaggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgttgtatcttggtttagtaacaggcccttaattaacttatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatctttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtctcttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttgaaaagaatcaacttagtaaattatgtcttgcacattccaaataggaaggtatttactttatcaagatgtgtttcatttgtgttctgagtaccagtgaggggataccgtggtacagtgttttgaattgtgtactaatatcattaaagcatgggattttagtggcttttt

SEQ ID NO: 1800 - DNA, 2679 bp, Homo sapiens
cttgtatcacaagaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgttgtatcttggtttagtaacaggcccttaattaacttatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatctttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtctcttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttgaaaagaatcaacttagtaaattatgtcttgcacattccaaataggaaggtatttactttatcaagatgtgtttcatttgtgttctgagtaccagtgaggggataccgtggtacagtgttttgaattgtgtactaatatcattaaagcatgggattttagtggcttttt

SEQ ID NO: 1801 - DNA, 4270 bp, Homo sapiens
aagaaatggggtcagcaggagttccagcatctcagaattgtggtgaaaaccaatacaaaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaa

SEQ ID NO: 1802 - DNA, 5065 bp, Homo sapiens
gcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaaccagc

SEQ ID NO: 1803 - DNA, 851 bp, Homo sapiens
gttcccagccgctgggaagcccctagacgcgccgaggggccgggctacgagcggctgagcacacaacaggtaatacattctaaacgcctcgtgtcaaaataaggagagtccttatttgtgcaccgtggggcacagttaaggagcaggaagaagacaaaggaggccgttatttatgtgccgtcctattatcaaaactttccgtggtggggcagggtgcgtggctattggcctctgctgaatggactttcagagtgattgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggcc

SEQ ID NO: 1804 - DNA, 643 bp, Homo sapiens
gggagcggggtagggcggcggcgagaacgggcgcctcgctgaccggggagaagaggcctcctgccaaggggccctagtgtagccggagtgagaggaggggccccggacgtagcctgctcttccccggtgtggagccattacggggggacattcctcctgcggcggggggagggagccccctttcttttctttgagaggtcagaatccgcagtccgcccttcgcctttaaataaaagcctgccggctcgagatcggcgtcgcgatggagtgcccgtggacttctacgcttgcggaactccgagtggacggatagcggcttatgaattttgctttttagagggtacacaaccctttctctagggtggcgtgcatcttctgcaaacttgttattgccaatacgctaatagtcgctttcagcacacaacaggtaatacattctaaacgcctcgtgtcaaaataaggagagtccttatttgtgcaccgtggggcacagttaaggagcaggaagaagacaaaggaggccgttatttatgtgccgtcctattatcaaaactttccgtggtggggcagggtgcgtggctattggcctctgctgaatggactttcagagtgattgagaaaatgatgcatcctgttgccagca

SEQ ID NO: 1805 - DNA, 1891 bp, Homo sapiens
ggatcatttcacctgtaacagaatacccaactcaggcttggcccaacagtcaagttgagccaagccaacagacttggctcaatcagctcgcatgactggaagttcatcagtagagtggacatcatggcggtttgatctagcagcacaggagtcattaaagaaccagtttctctttctctgttttgccatctgtagttttgggtatatcctgaggttgataggttcagtgagagggagagattgacttcccatggctgcctcttaaatcaaatgatctacaatcctagagattccagtagatatctgattgcagcttaggtgttagaaaattataattatctgcagatgcctagatcctttgaacaagtaataatacttaaaaaatggtttctgaaaccttataagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgccaagcactgaatgccaagaatacctcctgaactctctctccaactgctcagaagctctaaaagcatgaaaagtggttaaaatcttacaggaccaaacctgcattatttaatcagtaggttgtaatttctaactctagtaaatatctttttttaaataatcctatcctagcctgttctcaaatatggcttaaatatacaaggtatatatattttttaataaattatttatctatacttttttgaaacaggttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtagaaacaaaaggatcaagtgtgttataaaacatttgatgttaaaaggagacaataaaaaggcaatggtttttcaaaa

SEQ ID NO: 1806 - DNA, 2061 bp, Homo sapiens
gcggggctcggggcggggccggcgtggcggtggcccgggttgtagccgccgccgctgccgccgccccgccgccgccacctcagaagcaggaaccgaagtcgtcgccgccgccgccactgcctgggtcttcggtcggggcccgcagccatggaggatttcatcgtgatctcggacgacagcggctctgagagctccgggggcgcccgcccgggccggtcgcggaggccgcgccgggccctgtcgcgaacctccggcgcgctgccccgccggaccgtgaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgccaagcactgaatgccaagaatacctcctgaactctctctccaactgctcagaagctctaaaagcatgaaaagtggttaaaatcttacaggaccaaacctgcattatttaatcagtaggttgtaatttctaactctagtaaatatctttttttaaataatcctatcctagcctgttctcaaatatggcttaaatatacaaggtatatatattttttaataaattatttatctatacttttttgaaacaggttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtagaaacaaaaggatcaagtgtgttataaaacatttgatgttaaaaggagacaataaaaaggcaatggtttttc

SEQ ID NO: 1807 - DNA, 978 bp, Homo sapiens
atggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccacctggggaacagagcaagactccgtcaaaaaaaaaaaaaaaaaaaaaagaaaagaaatccctcctaatttccttctttttaatctctacagaacaagggtcaaaaattag

SEQ ID NO: 1808 - DNA, 2004 bp, Homo sapiens
gttgtagccgccgccgctgccgccgccccgccgccgccacctcagaagcaggaaccgaagtcgtcgccgccgccgccactgcctgggtcttcggtcggggcccgcagccatggaggatttcatcgtgatctcggacgacagcggctctgagagctccgggggcgcccgcccgggccggtcgcggaggccgcgccgggccctgtcgcgaacctccggcgcgctgccccgccggaccgtggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagcctgccgagtgcctgcgattgcaggcacgcgccaccacgcctgactggttttggtggagacggggtttcgctgtgttggccgggccggtctccagcccctaaccgcgagtgatctgccaacctcggcctcccgaggtgccgggattgcagatggagtctcg

SEQ ID NO: 1809 - DNA, 1925 bp, Homo sapiens
gctcggggcggggccggcgtggcggtggcccgggttgtagccgccgccgctgccgccgccccgccgccgccacctcagaagcaggaaccgaagtcgtcgccgccgccgccactgcctgggtcttcggtcggggcccgcagccatggaggatttcatcgtgatctcggacgacagcggctctgagagctccgggggcgcccgcccgggccggtcgcggaggccgcgccgggccctgtcgcgaacctccggcgcgctgccccgccggaccgtgaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgccaagcactgaatgccaagaatacctcctgaactctctctccaactgctcagaagctctaaaagcatgaaaagtggttaaaatcttacaggaccaaacctgcattatttaatcagttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtagaaacaaaaggatcaagtgtgttataaaacatttgatgttaaaaggagacaataaaaaggcaatggtttttcaaaa

SEQ ID NO: 1810 - DNA, 3572 bp, Homo sapiens
gctcggggcggggccggcgtggcggtggcccgggttgtagccgccgccgctgccgccgccccgccgccgccacctcagaagcaggaaccgaagtcgtcgccgccgccgccactgcctgggtcttcggtcggggcccgcagccatggaggatttcatcgtgatctcggacgacagcggctctgagagctccgggggcgcccgcccgggccggtcgcggaggccgcgccgggccctgtcgcgaacctccggcgcgctgccccgccggaccgtgacggtgtcttgctgtgtcactcaggctggagtgcagtcgcacaacctcagctcactgcaacctctgcctcccgggttcaagtgattctcctgcctcagcttcctgagtagctgggattacaggctgaacaagaagcatggcaccagcatctgcttctggtgaggacctcaggaagcttccaaccatggcagaggtgaatggggagcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagggacaaactctgcctgggcgagtccttttcctgcgttatgtcgttcagaccctagaagatgactttcagcagaccctgaggaggcaacggcagcacctgcagcaatccattgcaaacatggtgctttcctgtgacaagcagccccacaatgtcagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgattgtgtgccagcttcagaggatgctctccatagccgtagaggtggacaggacccccacctgcagctccaataaaattgccgagatgatgtttgggtttgtgctggacattcctgagaggagccagagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcagtcagataaaagccagtggcagacttgggacgaattggttgagcatctgcagtttctgctgtccagttatcaacatgttttaagagaacacttaaggagttccgtgatcgaccgaaaggacttaataatcaaaaggattaagcccaaaccccagcaaggagatgacatcacagtggtagacgtagagaagcagattgaggccttccgcagccgcctgatccagatgctgggggagcctcttgtcccccaactccaagacaaagtgcacttgttgaagctcctgctcttctatgctgcggacttgaaccctgatgcagagccctttcaaaagggctggagcggctcctgagggcctgccaagcactgaatgccaagaatacctcctgaactctctctccaactgctcagaagctctaaaagcatgaaaagtggttaaaatcttacaggaccaaacctgcattatttaatcagtaggttgtaatttctaactctagtaaatatctttttttaaataatcctatcctagcctgttctcaaatatggcttaaatatacaaggtatatatattttttaataaattatttatctatacttttttgaaacaggttaatactctgtgcatcacatgtttaacattttcattcaagatgtggaaaaaatccctctgctgaacctagtctatacaccaatattatgtcattcaaggtaccgacaacctgtttcaggagagagacgttcatttttccctaatgaaatgcaagcattctgttagacctattatattgcctgttaatttgactgtaatgaatagggggtagaaacaaaaggatcaagtgtgttataaaacatttgatgttaaaaggagacaataaaaaggcaatggtttttcaaaata

SEQ ID NO: 1811 - DNA, 804 bp, Homo sapiens
ggcaacccactccagtccccttctgcactgtggaagctttgttcttttgctctttgcaataaatcttgctactgctcactctttgcgtccacactgcctttatgagctgtaacactcactgcgaaggtctgcagcttcactcctgaagccagccagactacgaacccaccgggaggaacgaacaactccagatgcgccaccttaagagctgtaacactcaccgcgaaggtcccgcagcttcactcctgagccagcaagaccacgaacccaccagaaggaagaaactccgaacacatctgaacatcagaaggaacaaactctggacacactgcctttaagaactgtaatactcaccgtgagggcccgcggcttcattcttgaagtcagtgagaccaagaacccaccaattccagacacagtgggatcacagagagagccaacagtccaggccatgacaagctggcacccagctctgcttcacatgatcaaactgcatcacggaagctgcacacgatgacaccctgtctggaaagtttttgccagagggcaaaagactgcaagcagaatatccctttgccatttctcattcaggactggccgttgtctgaaagcaaacctcaaggacaggacttctggactccgcagccacttcaggctgctgctccatcgcatgaattccagcaggtggcgctgcaccccgcgcggacccggcttgcctctcggccccagggaggtcggttgatgagcagtcgggaagtgggtctgcgcgcaccccgctgcagctgtggcaaacgcaaacgatga

SEQ ID NO: 1812 - DNA, 2052 bp, Homo sapiens
ggcaacccactccagtccccttctgcactgtggaagctttgttcttttgctctttgcaataaatcttgctactgctcactctttgcgtccacactgcctttatgagctgtaacactcactgcgaaggtctgcagcttcactcctgaagccagccagactacgaacccaccgggaggaacgaacaactccagatgcgccaccttaagagctgtaacactcaccgcgaaggtcccgcagcttcactcctgagccagcaagaccacgaacccaccagaaggaagaaactccgaacacatctgaacatcagaaggaacaaactctggacacactgcctttaagaactgtaatactcaccgtgagggcccgcggcttcattcttgaagtcagtgagaccaagaacccaccaattccagacacagtgggatcacagagagagccaacagtccaggccatgacaagctggcacccagctctgcttcacatttgtccaactggcgtggctgtagctccttcctgcaaggcaatgctgaagaagctatggaagcaagaaggaagcatggattctaaaaactgacaacaaaccacttacccctattgctcttcttcctaaagctaaaggatcaaactgcatcacggaagctgcacacgatgacaccctgtctggaaagtttttgccagagggcaaaagactgcaagcagaatatccctttgccatttctcattcaggactggccgttgtctgaaagcaaacctcaaggacaggacttctggactccgcagccacttcaggctgctgctccatcgcatgaattccagcaggtggcgctgcaccccgcgcggacccggcttgcctctcggccccagggaggtcggttgatgagcagtcgggaagtgggtctgcgcgcaccccgctgcagctgtggcaaacgcaaacgatgacacacaggcttgacgagggcctttgtcagaagcaatggggatctggcgtcaccgcacaatggaaaacaaagtgcttctgcctggctggccagaatgcacgtttgctcactattgatgctggggcatttacaggcagaatgagttcatgtgaaatttcaggatctgccatgactcagattcactttctgtaaaccagagtcaacattacatttccctttactctgggccattccttgaatttttaggtcaccagttgtttttgtactaactgaagggatttgagtatttcacaagcaccttatttttattagcatttttagggcattaccaatttgggacggatctgtagtgtgagagattgttgtcactcttagctccaaacataggttgactttatatattatttacatgttcagaattatactgtgtagaaattcaaatgaaacttgcaaaatacttttctggcaggaagccctggagaggatcgttcatggaaacaaggatgacgactggggtaagaaatgcaggtgactcgtgagtggtcagggagtggaagagaagacggctggaaggttttagcattcagaaaaaaaatggagacaactagagttgatctgaagattatggcagaattcaatattgggggaaagaaacaagatgggggttagaaattagaaacagcagagctccacaggttggaaaggttggaaaggatttgagcaagagaacaaggagcctgctaatagcaccctgggtttacatcaagagaagcacctggagagaattaactcgggaggaggtgggggcatgggaaaccttttcatctccaagagcgggcaggaacagcagctggcctgaacttgaaggtacaccaggtagcttgcgtgggccaggagaaggtgattctcttctatgcctctctccaacgccctgcttctgatgctgctcctctacctgtattgaggggaagatacatccctaagaagttccctgaaccccattctttgttgtggctaactggtccccttggaatttttctactaattttcaattccccctctcacctggtgaaatcttgaatcttactgttcaataaaagttcttctaccgaaa

SEQ ID NO: 1813 - DNA, 3049 bp, Homo sapiens
ggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacacacattgttgtgtggtgctttaaactaggtccactatcaacaggctacttactgttcaagaattccactgaagcacttattttaaggccctatttttcttaaacaaaacagtgacaacaacaatcaaaccatttacttttgatgctcattggcattttatgataaaagatgtattcatggcaatgatatgtattcaccctattaggaaacacaactggttacctatgagacctgttctgtccgtgtgcctacgttccttaataatagctaaataaaaatttgtagctttt

SEQ ID NO: 1814 - DNA, 2933 bp, Homo sapiens
cccttggccgctgttcccgcaccgcggggcagcgggcctggaggcccctttgagaagtagctttccccggccggcggcacctttggctgcgtgcccggccgcgctcagggtgcgactgcccgggtcagatagcacctcagggcgagccccggcggtctgatctcgccgaccctcctcgtcctggttgcaacccgcgtgcgaggccgcccgcgccctccgagtgtctgccggtgcagtgggggtggactggccggctgtggccgtgtgtgcgcgtgtggattggggcccggtccgagccagaagcttaagcggcagatgtcgggcattgccaccctcgccccacctgtcgcgggtggactttggggcagtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacac

SEQ ID NO: 1815 - DNA, 1573 bp, Homo sapiens
ctctccgcctcgtgtctgggccgggcgcacgatgcccgcggtgctggggaaacccggccggaccagcttctgcgatgggcggcggggcggccccagcgtcccttggccttggtggaccggttcccaggcacccgaaggggactggggtctgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaa

SEQ ID NO: 1816 - DNA, 3049 bp, Homo sapiens; identical to SEQ ID NO: 1813

SEQ ID NO: 1817 - DNA, 1334 bp, Homo sapiens
tactggcgggactacttgttgcaaggtttatggggaaaagtagccagagagcaatccagttatcagcctcagccccattccgctcaggtacagctcgggaagtaagcccccaaccctagttgggtctggaccaacaagacacgaggaggcagcagcccacagccgacccctcatgccacgcactgagcagggttccgcatggacgctggtcttgcctcccaggcgcctgaactagcggagttggggtatcgggtggagtctcggagaaccaatccaatctgagggggacgcctgtgggagtcctaagtatccagcgcagctgggaggcccacgttgggaagtcggagaccgaccccgcctcccgactgcgccgactgcaagagagcgcttccggcggcgcttggaggccgagcagttgggggcggggctcgtgctgtgacgcaagcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctc

SEQ ID NO: 1818 - DNA, 2507 bp, Homo sapiens
gcggagctctgaagcggctccctgagggcgctggttttgaactggtcttgtgcggtttgcgctttctcttagtggttacagttggcgctgtctccgctttcctgtttcgtggcgggcatcttggccaaaacactctccctgccaccttattcctctagggttgtgatttttttctttcaccaagaaatatcactcgctggtaatttgtcaaactgaagaaacccctgaagaagcagtcgtgggcaggcgccgacgctgcggcttccagagcattttggcaaatcaaagccagggaccgttgctgggcctcatttccgcaacttttcggctccgaactgcttctttgacttagaagatatcttatcctgccgttgtaatggcagctgaactgcgaatgatactttatgaagatgattcagtacaagtacaatatgttgatggttccacattgcaactttctccctgtggcactgaatttttatttgaaaagtcaccacctgtttcagcacatcctttagaacaaccagaaagaattcgtcaaaggacacattttgtcattagcacttacagagagcaactacagcgagccctagattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttgtctttagcacttcattttcataataaaatcagcaatatgtctaaaattgatgcacatataactcagagtagatttttaacttctgatatttcagaggaaagaggaaaagtggtttctgttcttcccagggccctgtcactcagctgtccagtcccacacctacacaggtggaatttttgtgattcacttttacagagacaatctgatgaatattcctatcctgaactagtgaaaatggtttggtacaaaggtgttacatatagacttacccatcaaaatatgaactcaatagagatttattctggggatggatctgttttcaaatcagaaggggcttattttgggaactattttacttattattctattcaagaaggatcaggaaagagagaagagaaaacttactcagtaaataaccttcctccagatagaccgggaagtccattcactgtcggttctctaattaaacaggcaacaagaattcttcaacattgtgtgaagatgagactttctttaagccataactatcgtatatgctgctggaaaatggtacctgggataaacgatagcaatatactgcctttggttttgaaagagtcactcatacccagtgtgggaagatttcttgcctactctgatgacaaagtacatgctatctttttagatggcattactctaaccctaaattggaatttcagctctcctattgagaagagacaggtaaatcaaggtcttaacttaggttggtgtaagttaacttttcctgatggacaagagcagttaattcagattgaacaccctgaaccatatgaaagatatgtgacaacagtaacatcatggtgcaggagactgacccagactagtcccagagagatgcccactcattcgtcatcttctgttctccaagaaaattggtctgttgcttctgaacttgaaaagatacagaagtttaacttgctactagaaaatagtggtatcctaaaccagatttctaacaagaaaaatgaacaacagtcttttgatcattataaaccaggatcttcagaaaccttgctaggagaagttaatgaaaatagagtatcaatagcattgaaaaaaacctctgaaatccttcacgatattgactgtcttctatcaaactctaaaaagtgaaaaatggaattattacaacatattattaaagtttaaggatgttgtttcaagtgactggtataaaattactagtaagccaagatattgtacgtattaccccggcacaatgattgtgaaagaactgacatttaactttgaaggtatttttaacttgtacatttttaaaatatgtatttatatcttaataataaatatttcgaagttttgaacgttt

SEQ ID NO: 1819 - DNA, 1619 bp, Homo sapiens
agacagccgtgacagagaaactaggcggtccgctcctgggacgcggtctcgggggcgggttcgcccctgaggcccggtgacccttcgcccgcaaccagggctagcgcttgtgtgcgcccacggaagcacccgagcgaccggagaaagaaaaagtggtcaaggggacctccttccagctctacgcgcctctcattcagagaggtgaggtcaggaaaggggaaggacgaagccccagagcaacagaagtcaggcggtgccaggaacactgagagcggagccaggggaaggcggccgagcgcggccccctctcctcccgggccggggcgggcccgaggcctcgatccgccttccccgcgccgtcctggtcacggccccgcggggcagccatgcctggccgtctgctgcggggcctgtggcagcgatggcgccgttacaagtaccgcttcgttccctggatcgcactgaacctaagccacaacccgaggaccctccgatatgttccagaggaatccaaagacaaagttatctcagatgaagatgtcctaggaacattactgaaagttttccaggctctattcttaaatgatttcaataaacaatcagaaatcttgtctatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttataaaa

SEQ ID NO: 1820 - DNA, 1398 bp, Homo sapiens
agacagccgtgacagagaaactaggcggtccgctcctgggacgcggtctcgggggcgggttcgcccctgaggcccggtgacccttcgcccgcaaccagggctagcgcttgtgtgcgcccacggaagcacccgagcgaccggagaaagaaaaagtggtcaaggggacctccttccagctctacgcgcctctcattcagagaggtgaggtcaggaaaggggaaggacgaagccccagagcaacagaagtcaggcggtgccaggaacactgagagcggagccaggggaaggcggccgagcgcggccccctctcctcccgggccggggcgggcccgaggcctcgatccgccttccccgcgccgtcctggtcacggccccgcggggcagccatgcctggccgtctgctgcggggcctgtggcagcgatggcgccgttacaagtaccgcttcgttccctggatcgcactgaacctaagccacaacccgaggaccctccgatatgttccagaggaatccaaagacaaagttatctcagatgaagatgtcctaggaacattactgaaagttttccaggctctattcttaaatgatttcaataaacaatcagaaatcttgtctatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaaggtgacatgactgtctacgtagaaaactccaaagaatcaacaaaaaatcgcctgtaactaataagcacttacagcaaagtttcaggagacaaggttaatacacaaaagtcaactgctttcctatataacagcaatgacgattgaaatttgaaatttaaaacacaagaccatttacattagcaccccaaaattaaaatactt

SEQ ID NO: 1821 - DNA, 2234 bp, Homo sapiens
gggtgccccccaccatccccagcccgcagcataatcggtgaagggagcctgcggtttctccgccgcgccttcgcccgttgcgtcctgcgaagccagtggaatcggtggtcacaaggaaattatgacaggagcaacctgcaggggtttagatctgacagaaatattctaatggtaggcattgcatcgcttagccatatttgtaatttcttctttgtagggttggttctctgtaacttttgcttaccttaaaattatttttgtgtcttgctctgaggacaatgttaccgatgtgtttttcatttttacttgcatttcagactttcattattttaaattatgtattttttttttcttctaattttgagcgtctcagattcgtgcttcttgactttcattctctcaggagccggggagccgagctcggtcttagcctcgctggtatcaggttccgggttctgtctggaggctccgcttcctatgcagagctggcggttttgtatcagcacgtttgccagtggcgcccactgggcgttttctcagttgctgcacccaacgtgacatttcccgttcgcggggtccttaggttctcagtgctgtcactttttcgctcctacaaccgctagtatctcctaggaacttcctgaaccccgttttgccgtgcagaacggtgattgcaccgagccgctgttcgcactagtaattgtgtggtaccattagccggcgctttttctgtcacaacccattaaaacgggttaaaacatattaaacctatcaaacacattgaacggattaaaacacattaaatgccgcaacacatttttctggtacaacacattgaaacagagttggttcattcctccaaacaggttgtttaggtgtggaagcaccgctcttagttctaagagcatgctgtttctctttagcagcaccctttacggcgccaaaacggatatttgtttggcaataccagcgctatccgctaggtgccggcgcttgctaagttcaacgcgccagtttctcgtttgcaaggtggttagggcagagccctagcagacagttttccggtggcagcaacgctcatttcccggaaacgggtggttcttggcccttgcgcgctcttgaatacctgcgttctgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagagcataaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagaggcacccgtagaagaggtggggcaggcagaggaacccgacagactcaggctccagcagcttccctggagcagtcctctccatccctgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgtgctttcattgctggttgtcagtttttaaattctctttttcccttatgtttctttcttgtttcgcgtcgcttattactttcagtttccttgtattttaaatatttgtatttatttcattaaatatttcattcgtatctgtt

SEQ ID NO: 1822 - DNA, 7778 bp, Homo sapiens
gagtcacgcgatttccgggaacccgtcaggaaggacataaacaaaacaaacccgaggcagcatggagaggggccgtggcccctgcagcggaaccggacccagtccctgagccgcccctacacccacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaa

SEQ ID NO: 1823 - DNA, 7463 bp, Homo sapiens
attcccaagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaacgtt

SEQ ID NO: 1824 - DNA, 1660 bp, Homo sapiens
gggaacccgtcaggaaggacataaacaaaacaaacccgaggcagcatggagaggggccgtggcccctgcagcggaaccggacccagtccctgagccgcccctacacccacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttggattgg

SEQ ID NO: 1825 - DNA, 2466 bp, Homo sapiens
gagtcacgcgatttccgggaacccgtcaggaaggacataaacaaaacaaacccgaggcagcatggagaggggccgtggcccctgcagcggaaccggacccagtccctgagccgcccctacacccacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttggattggatatgtaattggtttttctattcaaatagctctaaaatgatcacttttgctcacatagggattcataagctgattccttgagggcttattttttattattttatttcttatttttaaaattaaaatagagatgagagcttgccactgtgcccagctgaggacttattcttaatgtatcttatgttaagtgacctgttttgtcactctcttgagcatttatgcaaagacaccaataatttattggtttaaaaaatattcctgtttagggccaggcgcagtggctcacgttagtaatcccagcactttgggaggccgaggtgggcggatcacctgaggtcaggagttaaagaccagcccggccaacacagcgaaaccctgtctctactaaaaatacaaaaatcagatgtggtggcacgcatctgtaatcccagctactccagaggttgaggcgggagaatcacttgaacccaggaggctgaggttgcggttagctgacatcgcaccattgcactccagcctgggcaacaggagtgaaagtctgtctcaataacaacaaaaaataataaataaaaatattactgtttatgcatgtgtctctctattatagttgagataagttaggagtatatagaatgttgaaccaagtgatgatggtttatattactcattccaatacccaacaaagtctatttatgaataatgtaaaagcattttctttgtgtctgctaacattttaatttacatcgtattttcctatttaagaaaaatacatgctgtaatttggtgagcatgaa

SEQ ID NO: 1826 - DNA, 559 bp, Homo sapiens
gaaggcgagtccgatcggaccaggaagtagctcaggggagcctgacctcgacccgcctttctcctcacacgagctgaggaggcagggaagtaccgagggcagtcaagcctcccctgggggtggttcctgggactagatggagctcagtctctggattctccctctttctcggccctatgcttcctgacagacctggccgccaaaccctgtaatcgccctcctttaacccaagaaagcaagtctttctgccgtttctgagctggcttgagccttaagactaccttaaggagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaact

SEQ ID NO: 1827 - DNA, 2557 bp, Homo sapiens
gaaggcgagtccgatcggaccaggaagtagctcaggggagcctgacctcgacccgcctttctcctcacacgagctgaggaggcagggaagtaccgagggcagtcaagcctcccctgggggtggttcctgggactagatggagctcagtctctggattctccctctttctcggccctatgcttcctgacagacctggccgccaaaccctgtaatcgccctcctttaacccaagaaagcaagtctttctgccgtttctgagctggcttgagccttaagactaccttaaggagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgt

SEQ ID NO: 1828 - DNA, 7788 bp, Homo sapiens
gagtcacgcgatttccgggaacccgtcaggaaggacataaacaaaacaaacccgaggcagcatggagaggggccgtggcccctgcagcggaaccggacccagtccctgagccgcccctacacccacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggtagtggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaacgtt

SEQ ID NO: 1829 - DNA, 11250 bp, Homo sapiens
ggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggagaatcttgggactgttttacttaattggtcattgatagcttaacaaacatggagataagattagaaatcttgacatcaacaggtattaagcagaaaaaaccatggccacgtgtctcctggttgggaaaggaaaaagaagccgtttttcttttggatgataaattcataaatgaaattaatttgctatcaggaaagataaagaagaaaattcctagtctgcagcctttcttgaaggatgttattgtcctaacaacatccagtaatgatgcctggctggctggggtactaactacaggagagcttttcctttggaacaaagatcaagattgtttgaaaactataccaataactgaaaagcctaaggaaatgatcaaagctacagtcgcaagctctttgagactgtacttgtatgtatctggaaatgggaaaagaattgtgctcataacaccttctggatgcatatttctttgggaatatttggaattaaagaatatcttatcttctaaaagcctttcattggcgggtcggtggtcccaggtcatacctgaagaagcagttctcttgccttccaccgaagataaagaagctgtagtgaatgctgtttttataaaaaatgagttatttggagactgctgcctgtgttcatttactttttattctggggaatgcctgaagttaacatttctagcaattcggtggcatgagaatgtatttacatctgtaagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggcaactcaggtattatttataaacacactgaattttgttactctctgtggtagccttaaaggatgtagtaacaagagtcccgtggttccagctacacttattaggtcctactgggtaggtgatatcagctggacgcatgatagtctttttctggcttgtatgttaaaacgtggctctctggttttattgacctgccaaggtgaattgctaacattaattacatttggttgctctatagaatttggcccagcagaatttattcctcttcatccactaataacgtatagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcatcctcaagtagtaaatcctgtgcaacagccaggacacagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggggaagaatgttttttattaggatcatatgaaaagtctgttcagctgtggaaaaaagctctacaagaaatcgaagagaaaggaggaagaaggacgtattttcttcagatacgctattatctttctctcttatactgccacctctatagctataatttaaatgatgctcaaggattgtgtgatcagctagcaagagaaatcctgagatggtcccaactacctgtaaaagaaaataaagatttttcaggtgctgcaaagtctcattttgagtgtggaatggtgggcggtgttcatcctgaggcagcagtgagagtcgtccagtccatggctcgtttcatggctgcctatttcaccaatcagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaaaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagatatctcttt

SEQ ID NO: 1830 - DNA, 9027 bp, Homo sapiens
ggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggagaatcttgggactgttttacttaattggtcattgatagcttaacaaacatggagataagattagaaatcttgacatcaacaggtattaagcagaaaaaaccatggccacgtgtctcctggttgggaaaggaaaaagaagccgtttttcttttggatgataaattcataaatgaaattaatttgctatcaggaaagataaagaagaaaattcctagtctgcagcctttcttgaaggatgttattgtcctaacaacatccagtaatgatgcctggctggctggggtactaactacaggagagcttttcctttggaacaaagatcaagattgtttgaaaactataccaataactgaaaagcctaaggaaatgatcaaagctacagtcgcaagctctttgagactgtacttgtatgtatctggaaatgggaaaagaattgtgctcataacaccttctggatgcatatttctttgggaatatttggaattaaagaatatcttatcttctaaaagcctttcattggcgggtcggtggtcccaggtcatacctgaagaagcagttctcttgccttccaccgaagataaagaagctgtagtgaatgctgtttttataaaaaatgagttatttggagactgctgcctgtgttcatttactttttattctggggaatgcctgaagttaacatttctagcaattcggtggcatgagaatgtatttacatctgtaagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggcaactcaggtattatttataaacacactgaattttgttactctctgtggtagccttaaaggatgtagtaacaagagtcccgtggttccagctacacttattaggtcctactgggtaggtgatatcagctggacgcatgatagtctttttctggcttgtatgttaaaacgtggctctctggttttattgacctgccaaggtgaattgctaacattaattacatttggttgctctatagaatttggcccagcagaatttattcctcttcatccactaataacgtatagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcatcctcaagtagtaaatcctgtgcaacagccaggacacagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggggaagaatgttttttattaggatcatatgaaaagtctgttcagctgtggaaaaaagctctacaagaaatcgaagagaaaggaggaagaaggacgtattttcttcagatacgctattatctttctctcttatactgccacctctatagctataatttaaatgatgctcaaggattgtgtgatcagctagcaagagaaatcctgagatggtcccaactacctgtaaaagaaaataaagatttttcaggtgctgcaaagtctcattttgagtgtggaatggtgggcggtgttcatcctgaggcagcagtgagagtcgtccagtccatggctcgtttcatggctgcctatttcaccaatcagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaaaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccaggttttcc

SEQ ID NO: 1831 - DNA, 11199 bp, Homo sapiens
ggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggagaatcttgggactgttttacttaattggtcattgatagcttaacaaacatggagataagattagaaatcttgacatcaacaggtattaagcagaaaaaaccatggccacgtgtctcctggttgggaaaggaaaaagaagccgtttttcttttggatgataaattcataaatgaaattaatttgctatcaggaaagataaagaagaaaattcctagtctgcagcctttcttgaaggatgttattgtcctaacaacatccagtaatgatgcctggctggctggggtactaactacaggagagcttttcctttggaacaaagatcaagattgtttgaaaactataccaataactgaaaagcctaaggaaatgatcaaagctacagtcgcaagctctttgagactgtacttgtatgtatctggaaatgggaaaagaattgtgctcataacaccttctggatgcatatttctttgggaatatttggaattaaagaatatcttatcttctaaaagcctttcattggcgggtcggtggtcccaggtcatacctgaagaagcagttctcttgccttccaccgaagataaagaagctgtagtgaatgctgtttttataaaaaatgagttatttggagactgctgcctgtgttcatttactttttattctggggaatgcctgaagttaacatttctagcaattcggtggcatgagaatgtatttacatctgtaagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggcaactcaggtattatttataaacacactgaattttgttactctctgtggtagccttaaaggatgtagtaacaagagtcccgtggttccagctacacttattaggtcctactgggtaggtgatatcagctggacgcatgatagtctttttctggcttgtatgttaaaacgtggctctctggttttattgacctgccaaggtgaattgctaacattaattacatttggttgctctatagaatttggcccagcagaatttattcctcttcatccactaataacgtatagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcatcctcaagtagtaaatcctgtgcaacagccaggacacagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggggaagaatgttttttattaggatcatatgaaaagtctgttcagctgtggaaaaaagctctacaagaaatcgaagagaaaggaggaagaaggacgtattttcttcagatacgctattatctttctctcttatactgccacctctatagctataatttaaatgatgctcaaggattgtgtgatcagctagcaagagaaatcctgagatggtcccaactacctgtaaaagaaaataaagatttttcaggtgctgcaaagtctcattttgagtgtggaatggtgggcggtgttcatcctgaggcagcagtgagagtcgtccagtccatggctcgtttcatggctgcctatttcaccaatcagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaatagaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagatatctcttt

SEQ ID NO: 1832 - DNA, 11062 bp, Homo sapiens
gtgaatattatgcatcatttatattttattactattattgtttacagaatcttgggactgttttacttaattggtcattgatagcttaacaaacatggagataagattagaaatcttgacatcaacaggtattaagcagaaaaaaccatggccacgtgtctcctggttgggaaaggaaaaagaagccgtttttcttttggatgataaattcataaatgaaattaatttgctatcaggaaagataaagaagaaaattcctagtctgcagcctttcttgaaggatgttattgtcctaacaacatccagtaatgatgcctggctggctggggtactaactacaggagagcttttcctttggaacaaagatcaagattgtttgaaaactataccaataactgaaaagcctaaggaaatgatcaaagctacagtcgcaagctctttgagactgtacttgtatgtatctggaaatgggaaaagaattgtgctcataacaccttctggatgcatatttctttgggaatatttggaattaaagaatatcttatcttctaaaagcctttcattggcgggtcggtggtcccaggtcatacctgaagaagcagttctcttgccttccaccgaagataaagaagctgtagtgaatgctgtttttataaaaaatgagttatttggagactgctgcctgtgttcatttactttttattctggggaatgcctgaagttaacatttctagcaattcggtggcatgagaatgtatttacatctgtaagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggcaactcaggtattatttataaacacactgaattttgttactctctgtggtagccttaaaggatgtagtaacaagagtcccgtggttccagctacacttattaggtcctactgggtaggtgatatcagctggacgcatgatagtctttttctggcttgtatgttaaaacgtggctctctggttttattgacctgccaaggtgaattgctaacattaattacatttggttgctctatagaatttggcccagcagaatttattcctcttcatccactaataacgtatagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcatcctcaagtagtaaatcctgtgcaacagccaggacacagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggggaagaatgttttttattaggatcatatgaaaagtctgttcagctgtggaaaaaagctctacaagaaatcgaagagaaaggaggaagaaggacgtattttcttcagatacgctattatctttctctcttatactgccacctctatagctataatttaaatgatgctcaaggattgtgtgatcagctagcaagagaaatcctgagatggtcccaactacctgtaaaagaaaataaagatttttcaggtgctgcaaagtctcattttgagtgtggaatggtgggcggtgttcatcctgaggcagcagtgagagtcgtccagtccatggctcgtttcatggctgcctatttcaccaatcagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaatagaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagatatctcttt

SEQ ID NO: 1833 - DNA, 2715 bp, Homo sapiens
gggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaa

SEQ ID NO: 1834 - DNA, 3221 bp, Homo sapiens
tttttttttttttttttttaaaaaaaaaactccggcaacgttggcctttgggaggccgcgtattgttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgccaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaa

SEQ ID NO: 1835 - DNA, 1410 bp, Homo sapiens
aaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagaga

SEQ ID NO: 1836 - DNA, 2730 bp, Homo sapiens
aaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagaagcaaatcgccaacgtgactactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgt

SEQ ID NO: 1837 - DNA, 1437 bp, Homo sapiens
ggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaaga

SEQ ID NO: 1838 - DNA, 1238 bp, Homo sapiens
agagggttcggagcgcgtgcgtggggcggggccgcggcgggacaaatgcagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatca

SEQ ID NO: 1839 - DNA, 1004 bp, Homo sapiens
gcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatcatttctctcta

SEQ ID NO: 1840 - DNA, 3576 bp, Homo sapiens
ggggccgcggcgggacaaatgcagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcagagttccccagacacggagctcctgcttccgagcttcctgttccttcaggaagtgaaatggatggagcagaatctggaaaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggatggctacaaagagatcttattttaaaagcagctgatggtttggaaatgagagaactacagtggtgaagagaccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagagaaagtgaaagccattaggcaagctatgtgctgggctgctaacgtagcccctgcagggaggggtcaggagcgcgctgcagtgagccttgggtctcgcaggcccagccctgctgcaaggagccagggcacccaggaaacatcagcacacacacacacagggaccctcccttcatgtcacttgttttgctgccctaaatggcttcttgcaccctaacccctgatcctggaagaaggcagagaaactggcccgtacagagacctgcaattctacgcaagcttaacacaactatgagacagaagaggggcacgcagaagaggtgggcaaaagtggtcacaacggcgggggatgctttgaatactggatggtgtccagagccgctccgatgtcatagttcttggtctgcaggagcctggtgagccagccgccttcatcagagaagcccatggacagcatctgggagagggactcaatcagccgcgggtcagcctctgccgaaacagtaaggaagccatgaggagtggtgctgagccctgtgagtgacccgaaacacataccctgctgccttggccagccaggaccagggtctgccagtgtccgagcctgcccagagctctcgtcctcacaggccacagtggacctgctttccctgtaaagggccaagcagtctttttcacactgctcaactctgccactgcgacaccaggcagccaggtggtgtgtaagcagaaccatcaatggacactgaaataggcatttcacctgtcacatcttttgattttaaaatgtaagaacaggccagttagccaattattacactcctccatgcaagagatgatggggcattgaaatagattgaagatggagagagatgaatggatacaagatacattttggaggtagaatgaacaggacttggaaatgtatgtggagaaggcaaaggagttaaagatgatatctggagcagcacaactcacaattgcaaagatgtggaaccaacctaactgcccatcaagcaatgagtggataaagaaaatgtggtatatatacaccatggaatactactcagccacaaaaaggaacgaaataataccttttgcagcaacttggacggagctggaggccattatcctaagtaaagtaattcaggaatggataccaaatatcatatgttctcacttatgagtagatgctaagctatgatgatgcaaagacataagaatgatatagctttccctctccctctttctccacggtctccctctgatgccgagccaaagctggactgtactgctgccatctcggctcactgcaacctccctgcctgattctcttgcctcagcctgccgagtgcctgcgattgcaggtgcgcgccgccacgactgactggttttcgtgtttttttggtggagacggggtttcgctgtgttggccgggctggtctccagctcctaaccacgagtgatccgccagcctcggcctcccgaggtgccgggattgcagacggagtctggttcactcagtgctcaatggtgcccaggctggagtgcagtggcgtgatctcggctcgctacaacctccacctcccagctgcctgccttagcctcccaaagtgccgagattgcagcctctgcccggccgccaccccgtctgggaagtgaggagcgtctctgcctggccgcccatcgtctggaatgtgaggagcccctctgcctggctgcccagtctggaaagtgaggagcgtctctgcccggccacccatcgtctgagatgtggggagcgcctctgccccgccgccctgtctgggatgtgaggagcgcctctgcctggccgcgaccccatccgggaggtgaggagcgtctctgcccggccgccccgtctgagaagtgaggagaccctccgcccggcagccaccccgtccgggatgtgaggggcgcctctgcccggccgcccctactgggaagtgaggagcccctctgcccggccaccaccccgtctgggaggtgtacccaacagctcattgagaacgggccatgatgacaatggcggctttgtggaatagaaagcggggaaaggtggggaaaagattgagaaatcggatggttgccgtgtctgtgtggaaagaagtagacatgggagacttttcattttgttctgtactaagaaaaattcttatcctgttgatctgtgaccttacccccaaccccgtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacgctgcggaaggccgcagggtcctctgcctaggaaaaccagagacctttgttcacttgtttatctgctgaccttccctccactattgtcctatgaccctgccaaatccccctctgcgagaaacacccaagaatgatc

SEQ ID NO: 1841 - DNA, 2522 bp, Homo sapiens
ggtctggccctaaccgctcccgcatccctcgcctgcacagtgggcagtctggcgcctgtggcgtcgtgtttgctgagggcccggctgccgttgactgaggctgcgatggcggcggcaggccggggtcgggagcaggactcggcgcgcttcgtctatgtgacgcgcttcggctcgcatcagtgcagtggcgtcctgcaactgggcggccgtggagctcaaggcctttggggtcaggggcctggggcaggctgtcgccaggagaagccgagggaagcaatggcggtggcgggcgttcagggtggcagcgagctgcccctcggttcccagctcagggtccccacgacccctggtgtggaggctgcggcctctgcctcctcccagctgcgggcatcgagagttcagagcggcaccagacagtcggcgcgtgcaggtttaatccagaaggatgcagctaaaaagtatgattttcccataccattgaatgaagcttccaaaataatgaagaaaaagaaaaaggttttagtatggaatagagtatacaaagtcatttcaagaatgcttgaagaaaatgaaaaatatagacacaggctgaaatgccaaaggttatctagtgaaagctcaaattacacaagatgaatcttcttatcttctggaataacctatctttggatgtttcccaaagaagagtatgaagaatctaaagatgaaacattaaatgaatcataattatttgttaattttgatgtgttttattagaattgggactttagtagtcgaacagaaaaattaccttctttataaattaataatatttctttgctacttaataatacctttagttaaatattgttaaccatatgcatgcaagtgttattttcagaattaatgcttattctacatacttttaaattaacctcatacataaaattaaattagcatatcaatgcaattgcatgaattttataattaccagcttttccattttattaatgagtctacaactgctgctttgttcatctcttcttttagatgtaactcttaaattaaacttggattcatttaaattatttttggcttcctctaaacttctcaattattttatggaaaaaaccttagaatttacatagcaacgattattttgggtgttaaaactaagctaatgattatttaagccatcttttcatcctaaggaaaattagtaaatgtatgcatttataatatggatatattataatggactatattataatatggagtattttaggaaaatttttgggcaaagatcagaggagatgccctttaccttgccaggcccctaagtaatacattatttttaagtcaatgaatgagaggattagaattctgaaaatcatttagaagtattgtttaataagtcctttttttctactcaacattaagtagtaatcaacttttacctccgccagtttttctgcttttttgctggtacgatctctctttctaaattgaatcaaagacctaggtggaactggaaacttaggagggaaagacaaaatgaggcttgttcatgatcaaattctgtgtactctagttgcttctttcccttggagtgacaggtacttttatatccaggatgattacagtgatgacatccattcttttttgggggcattgagaaggtgggcttcctaattattttacaaaggtattacaaagtgttaatatacaaaattctcatgaaatagtacaagttgtaaggactgtaaagtaattcatagttttgttttttcctctaatagttgtaacttaattacttcaggagactacgacagtgtagaatttgtggtaacatgatcttctagtgactatttatcaaatccacctgtttctagatgaaggacacattgcctggggaaatggcctcggtttttttgccatgtaggctctcaagtttccctgcattgagggtcacacaacttctttatattatgctgggtaaatttcaggctgctaaatccttgggtgaagcttcaaattttagcttatgcaactgaagtccattgcaaaatgagacatatttacactgtttatactgtaatttatgctgcataaagttttgtagtgaatgtgtatgagagttttaggtttgcttcaatgtatgtttatatttatgtgacttatacaacttgacatagtagtctgttttaatttattaggtatatcaatatttgttagatttaaaataagagtctaatgctggatacaaactcagtttatttcactgttctagaaccatggaggaatgaagactcccactgaaatgaatgttctaaatatttgttctaaatcttttaatttttgtttaataatttctggtgaatatgtgttcaatctgttatgttaaatagaatataataaacataagacttttctttactgatacatcactgaacataagctgcaatactttaacttatttctgttccataatttcagtaggggctaatgacccacccctgctacattaaagacttcagactgca

SEQ ID NO: 1842 - DNA, 464 bp, Homo sapiens
attgctgtcaggaatggcttcagggaaagatacttgtcctactttgcctaaactcactaacaactgctctgatgagagtctctataaatctgctaataagtatgaagagattcatttgccacgattttcattaaagcaagggatgatcccaagacgttatgtcatgccttggaaagaaaacatgatattcaggaatgtgaatctgaagcaagcagaagtgtgtgggatccatactggccctttagaagactctctgtttttgaatcacagtgaaaggctttgccatggggaagatcgtaaagttgtcttccaaaaaggcccaccagaaataaaaattgcagatatgcctttgcattcgcctctctccagataccaaagcactgtgatttcccatggcttcaggaggcgactagtctaatgaaagaagaataaaataataaagtgtttcaatctctgctctctta

SEQ ID NO: 1843 - DNA, 2385 bp, Homo sapiens
ctttcatgtgtcttctccagactgtaagcttcctgtggacaaggcctgctccgttcaaggctcaatctccagctcctgacacaccatgcgctaggtgctcagtcactaatggtctcgcgaaggagtgatcagtgagtgaagcaggggctgctgcatgggaaaggtgagcgggctggaaatgggtagtccccgcggcgtctcccagtcgggctcctcccgaggaggaaggaaggagagaccccaggtgtagtcgaggggccgggagggaggaggggagggtcgctccaccctggagcgggaatgctgcagggcagctccgggtcgccaggcggcggtttccaggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcggacaggaattatttccctctatgattgtatttttaagaggcgcctagattatgatcagaagttgcaccgagatgacagagaacatgcaaaaagcctgggacttcatgttaacgaagaggaacaggagaggccggttggagtgctgacgtcttctgtctatgggaagcgcatcaatcagcccattgagcccctaaaccgggactttggccgtgccaaccatgtgcaggctgacttctacaggaagaacgacatccccagcctcaaggaacccggctttgggcacattgctccatcctgaagcatccccgtggcccacagggcatgtccgataccctgtggcctggcaagtttgcacagcgagaaggtggcatctggagcctcctttccccttctcatgacgcctaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcacctgaataaaatgaaaactttgtttccccttggtaactgttgggttggtttctgttcactggctctctacatttgccaggattctttggggaggcagtcacaggagtgaggtgcagttgcttttcccacgagttaggggaactcctgctgcctgaacacaaacaaccctgacatgttcccttctccaagaggagatgtgatgacaattgtcttttggcacaattgaactctagaaactccatttttgtttttccagaggtctgaatcccaaataacagaattttgtgcagtagggaccaggagccctagtaaggatgggtggccctggtggccagcaatgctcactattactgctcagagagagggggccagtcatgggaagaggctagatttcggtgttcaacaaacttgggtaaaattctggttgctgcattttctagatttgtgttctagggcaagtcatatcatctacatgagcagacatttcctcatatttaaagtggaatttccaaacctagaggagttcatgcgggaggcaatgagctgctggagcacaggcataacacaggtacccagtgtgtgccccacccagtgccccgtcatcacagcaatgacttgactttaaacagtcttctttttggaagcagtcgcttgtaacctaagttggaaatacttactttggagataatttgaaacttacccaagtattaaagtatcatcagctacatttttaatgaatggatcccttggaagaaatcatctctcatctaccatgattaaatttcccacagtttagcagtgaatgggcaggtggcctaattaatttcaatactgatcgctccatcactggttttattgttttgaatatggaaaaaggattctctaaaaataaatgacactgaattccggcaatttcaaggctgagtgactcctaagtatttctttatttttttgaaaacagtttttcagtgtaggtgtcttttatttatttcaaacaaatggcagtagtttatttcgaatgcctttgggtgcattataccatatttatagtaacataatagaaaatatataaagtttgggttatagaaatatttataaattattcattattcagacttgatttcaacaaagacaaggcatctgtaagtgactgtaataaatcaaagtcaaactaaa

SEQ ID NO: 1844 - DNA, 468 bp, Homo sapiens
atggcaacccagcaagtggacagcagaaggcaggtggcagcagagcaggtggcagcccagctgcttgaacggagaaggggcagccactgtgatgacgagaagcagacgctgttggcattgctgatcttggtgctgtacttgagcacagagatatggggaagcagttgggaggtgtcagaaaggatcagagaatgtaactactaccagaatcttgcagttccccaggggcttgaatatcagaccaacgagccctcagaagaaccgataaagaccatcaggaactggctgaaggagaagttgcatgtcttctcggagaagttagaggaagaggtgcagcagctggagcagctagcgtgggacctggaactgtggctggatgctcttctgggagagccacaccaggaggagcactgctccacatataaaagtcacttgcacctggagcatgaggtcagcatcagagatcat

SEQ ID NO: 1845 - DNA, 5241 bp, Homo sapiens
gcacccgccgattgtggccatggcggccgcagtctctagtgtggtgagacgagtggaagagctcggggatctggctcaggcccacatacagcaacttagcgaagctgccggtgaagatgatcactttttaattcgggcctctgcagcattagaaaaattgaaactcctgtgtggagaagagaaagaatgttcaaatccatcaaatcttctagaactttacacacaggctattttggacatgacatattttgaggagaacaagctagtagatgaagattttcctgaagactcttcttcacagaaagtaaaagagctgattagttttctttcagaaccagaaattttagtaaaggaaaataatatgcatccaaaacactgcaatttgcttggggatgagctactggaatgtctctcttggagacgaggagccctgctgtatatgtattgtcattctcttaccaaaagaagagagtggctcttaagaaaatccagtttgcttaaaaagtaccttcttgatggaatcagttacttgctacagatgctaaattatcgatgtcctatccagttaaatgaaggagtttctttccaagatctagacacagctaaattactgagtgcaggaatatttagtgacattcatctgctggctatgatgtacagtggagaaatgtgttactggggatcgaagtattgtgctgatcagcaaccagaaaatcatgaagtggatactagtgtgtctggagcgggctgcactacatacaaggaacccttggatttccgagaagtaggagaaaaaatcttgaaaaagtatgtatctgtgtgtgaaggacccctgaaagaacaagaatggaatacaacgaatgcaaaacaaattttaaacttctttcatcatcgctgtaactagtaagttcatctagtccttttcaaatagaaaaacaacaaaacccatgaaatggaaaagagagttccaaaaaagaagacctgttgatactgaatatgagaacattacactgcataaagatatccagcttgggtaccctactaaaacaacatcaccatctttttcattatatattagtaaacctatgaagggatgattctttaatttctaaagtgttgttcaaactcaccttaaaatacagatgttatgtcactaataatgagtagtaacccaatttagctttacaaagattttttctattactttttttttttattgtggtatatgtaacacaagtttaccatttttatcatctttagattatttttaaatctcactaccttgaagtttgccatgcttcagaaattaaagtcaagttacttcactgctttgaatacatactatggatataaatgtaggcaaaatgaaagattatgactaatattcagattccattttcaataaggtaaataatgaaagatctcacaaaggaatcattgtgtttaattattttgccatgtattactaattgtatttaaaatttctacttcccttaggcattttataaaaatttaaaaattatttttctattttgtttaaaagacaatgcatggcttttcaagtgagtaatgaagataaaaaccaagctaggttagtctaccattagttcatatgtttttgtagcacatcttttcataacatactgaaattttaatgttttttgcctttaataataggggtgagtgttaaaggccagagagcctaacttgatatcttgctcatggtctttctgtctacctcaactcctgttgtcatctttggatgatctttctgataccttgctgataccttggacttctgcccagtgactttattacattccagcagcttactcccgtggccgcactttgaatgtcaccaccttgagtttctctttctggtaaaatttcagtaactgataactgccctcttttcagttttttcacttccttattttattgacttttctctcctttatgctcattccacattcttcagttccttcttacccccttttcttgactgctccccttcctcctaaactgtcagcccctttcaggctttcttccctatccaccctcagctttatgggatactatatgaactaatctcaccagttattcttctttccctggtcttttagtctagtcctttggcaagccctcaacctcagattaatcctatttattatctaccttttcggggatgctgagttctttgtgatgggtagtccttcaaagtagaatcactacaagtgtctcacttcagccttagaaaagccctcaatgtaaaccttatgtttgttactagggtggcctctctcccatttcccgctgtggctgagccaaacttcattactttccttaggccctctgcccctcccctagcatatggctctttctcctattgaacagaaaattgagactatgaagaggtcaacttgtatttaccaactttactcattttcccattttagaggaaaagaggttgcctgcttcctatcaaaggcgactctgtgctacatgttggtttcatcttcgctgtctctctcatttccccacaaagtgttgtctcactttctgcctaccttttaggtattgatcttcactatatttttttctctctctctcttttttttttttactttacatattttatacaatgtcattcataactatggcttcttttaccacctgtaataacagactgagtctcaaacctgtaacttgtatcctgacttatctcttgctttctaaaccttgtttctaactgtctatcaaatatcttcattagacatcccacagtaattttaagctcagtgtttccaaacgtcaagtcctcatctgttatataaaatcctttctgctttgtaagttttctctttttgggattttccgcagatcagggcaacacagaatgactaccttcccagccatgtctctgcagtcatcctgtgtaatcatgttctagtccagtgttgctcaaacagttaaaatccaggctgcttttggtaaacatacaaattctgatatagagcctctgtggcaaagggaatttctcagttcctgccccagcccccttgtttatcattacacagctaagatttttatttaacttagcattttagcaagttttcttatgaaaatacctttgtgctttctaagtataaagatttaaattatttttaatacggtttttagaaccacagactatccctctttttagagcatcctgatcaattgcaagtacttccacttcttccctaaatgcgctttgtgtgttttccacctcagtagccttgcacacatcattacttctgcatccttctttgtgaccaagtgaatacctacctacctcttaggactcagcttcagtgattctgttttcataggctttttaaagcccttttcagtcaaattagatgctcctttgttctggtcctttactcttcccctcccatgttgtcgcactgatcacactgctttgtaattattttctttattgttggtaaactccatattttaaaaatttacctgtatacatagtgcttaatgcatggtaggcccttagtaatgtttttgaattaatgaggcatgattctaaatgccaaactttgcacaaaaagttgttgctattggattccaaactgctatgccctctataccagtggctgacaaggcatatagggatatatgccatcctgagaggagtaaagtgtttagattctgaacctgagaaaagagaactttctcttaagaagttggaaacttcattttaccttcgtgaccctggtagaccacttggtctcactggttggtacaattatgagggtagtactgggtgctttttatacaactttccatcccccacacagttggagaataatttgtagaccatggcagttaaaatgctttttactctggtgtattatagaataatgaacacatttttatatatgttaaagcctgctaaatcattcacttagaatgaagtaacctcaaggtaccaaataccccacataaggaaagtactacactaaattcactcaactattgtatgcctaccatatgccagattttatcctagaccctgaggatatagctttttaaaaccccctcctgtttcagagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcgtattccgcacattgataaagtttctttcttacagaagttctgatattgaattaaggaatgggtcactacttaagactttatcatttcagctacacataaaaggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagacctgtgtgctctgctgcatttatagggttttgggctgctgagaataattgatgctgattaaggtgcaaatcatgactaaagacttttctttcttcttttgcatatagtagagtgaggtgagggtcgtggctaaaaccccacaataactttacattcctagctttacagtcttgctgtgaattctctggtgttcattaaagtgtgagctgtgttaaaaggcattcttagattcattttaaccacatttttaaaaactcacagttggttaacatgatggtttcagattgcttgcctcttttctctttctaccttacagggctccttttctagcttaaataagggtactccatctgccacagaatccaggattctatagttttttagtttcacttccctatgttctttttttttttttaatttttaacaatgagatgataccatgttacagcggtattacattaagatacatttaatatagccacaattaaagtatgtattatgtatttatgctggtgttctttcatgttatttcttctagtgaaaatttccaagtaaactgttattgagcatatacatttttaaaaaaataaaaccatacaccccta

SEQ ID NO: 1846 - DNA, 686 bp, Homo sapiens
cacctaggtgggctggcaaccagccaccagtttccaactctttctccaacagggaagccgcaatgacacagccgactaggccctcggtcacctgtgaccagggatcctccacgatcggcgggaccgccgcccaggcgaccaccagttccagcgccacctcgggttcgaactaccagcgcgatagactcggccgccgcccagaaatcggcgtagggggtcagccgcagatctgctttccgcggccgaggtccgcgcagcagccggtgctgttcagcttaatgaattccagtgaagcagcgatgaaaaaaactttacccaagagccatttatctcgggtgattattcatgataaccgcatcacacaacgaatctatgagatggaggtgagcgctttagagaagaccaagaaaaagatcagccactactatgaacacctgaaaaaaaagttcatgacagagcagctcagaaagctcgggcgatggagagaggaatccgtgaacagcaaccggtacttaaccttcgggataccaccaccagtttaaactccagtctcccaagaaaggccaaccaccctagttctggcaaagggatctgccccagggtcacgatgacaccagtgtgacccgaggagaactagtaactacaacctacacaactgtagaacaataaacagaaaccagcagaca

SEQ ID NO: 1847 - DNA, 2851 bp, Homo sapiens
gtgtgggagacgcctctcccagtttgcgggcgggaagcaccctggagaacccggatggaacccgggcctggctgaggcggaggttgttgcggatgcttctctctccaggcgcaccgcagattcctgcccgggggttggacccgaggaaccgccgtctctactggttccgacggccagaggctgggccctaggctgagcggagagtgggactggagcctgaaacgggcgcctaaaagaagcccgtgcatcccataggcctgcgcctcaggcttggagacgggcgggcggagaccgcgctgagtcttttttttttttttcctagcagctggcgttcttatctcacccgggaggctgtaaaaatctccgtccttaacagtaacaccatcaggtcctatcagttaagagctgcttgttatttgcatgcattcttataattaaatctcctaacaaccctgtaagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatttgcgtatttatgtgccaaggagaagaatcctcatacagtagctgaaaagttagtgaaaccttgtgcactggaaatagcacaaatagttttgggaccagatgcacaaaaaaagcttcagcaggtacccttatcagatgatgtgatccattctagaattgatgaaatgagccaggatatcttacagcaagttctagaagatatcaaagccagtcctcttaaagtgggtattcagcttgctgagacaactgacatggatgactgcagtcagctaatggcatttgtgcgctatataaaagaaagagagatcgtagaagaatttctcttctgtgaaccattgcagctatccatgaaaggaatagatgtgttcaatctcttcagagacttctttctgaagcataagatagcacttgatgtatgtggctctgtttgtactgatggtgcctcctctatgctaggagaaaattccgagtttgttgcctacgtgaaaaaagagatacctcatatcgtagttacacattgtttattgaatcctcatgcacttgtcataaagacattgcctacaaaactgagggatgctctgtttactgtggtgagggtaataaatttcatcaaagggagagctccaaatcatcgcctatttcaggctttctttgaagaaattggcatagaatatagtgtcctccttttccatactgaaatgaggtggctttcccgaggccaaatacttactcacatttttgaaatgtatgaagaaataaatcagtttcttcaccacaagagcagtaatttagttgatggctttgaaaataaagagtttaaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagttatttaatgaaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaagattaagtactactgcctagttgctatcatgagattttcccaattctaagtatctgtttaacctgttcgtgtggtatatgaaaaagatacctaagcactagaatatccagctaaatggtgcaataggctaggaattgagccaggagaaaagagaagatatcccagaagtcaaaaaggcaaaatgaaagattgagttcgcccgtctttgttatggagaggttaatgaaatcagaagaggattatgaaatataatgggaaaaggaatgatctggcttatgtaagacttacttttaaatatactctttggagttagtctcacaatgtccattcccctagctcctgtgctatgaatatcatattaataaatagcctaatatattaa

SEQ ID NO: 1848 - DNA, 2484 bp, Homo sapiens
ccgggcctggctgaggcggaggttgttgcggatgcttctctctccaggcgcaccgcagattcctgcccgggggttggacccgaggaaccgccgtctctactggttccgacggccagaggctgggccctaggctgagcggagagtgggactggagcctgaaacgggcgcctaaaagaagcccgtgcatcccataggcctgcgcctcaggcttggagacgggcgggcggagaccgcgctgagtcttttttttttttttcctagcagctggcgttcttatctcacccgggaggctgtaaaaatctccgtccttaacagtaacaccatcaggtcctatcagttaagagctgcttgttatttgcatgcattcttataattaaatctcctaacaaccctgtaagccacattctctggcacagaactttggaaactttggggatcacttacttatcttggagatagaatgttttctaagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatttgcgtatttatgtgccaaggagaagaatcctcatacagtagctgaaaagttagtgaaaccttgtgcactggaaatagcacaaatagttttgggaccagatgcacaaaaaaagcttcagcaggtacccttatcagatgatgtgatccattctagaattgatgaaatgagccaggatatcttacagcaagttctagaagatatcaaagccagtcctcttaaagtgggtattcagcttgctgagacaactgacatggatgactgcagtcagctaatggcatttgtgcgctatataaaagaaagagagatcgtagaagaatttctcttctgtgaaccattgcagctatccatgaaaggaatagatgtgttcaatctcttcagagacttctttctgaagcataagatagcacttgatgtatgtggctctgtttgtactgatggtgcctcctctatgctaggagaaaattccgagtttgttgcctacgtgaaaaaagagatacctcatatcgtagttacacattgtttattgaatcctcatgcacttgtcataaagacattgcctacaaaactgagggatgctctgtttactgtggtgagggtaataaatttcatcaaagggagagctccaaatcatcgcctatttcaggctttctttgaagaaattggcatagaatatagtgtcctccttttccatactgaaatgaggtggctttcccgaggccaaatacttactcacatttttgaaatgtatgaagaaataaatcagtttcttcaccacaagagcagtaatttagttgatggctttgaaaataaagagtttaaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagttatttaatgaaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaaga

SEQ ID NO: 1849 - DNA, 2113 bp, Homo sapiens
tgtctcaactcatctctttattcatgctactctttactattatcattcctataaaatgttataggaaaaataatagctaacagttatggagcacttggtatctgccaagcacctctgatgaattatctcacttaaccctcaaactaacactggaaggcagttattatcgttccatacgataggtgaggacatctgcactctgaatagttaatcgcttatctgcatctatacaactaagcaggtgatagaataggattcaaacccaagtggcttcattccagagtctgcacttaacgctaccgctatcctgtgcgactcaaatgcagataagggttgcaaaagcctggcacactgggggtaaggaatgtcagtgctttttccgccaacgtggccgcgcgagtcagttgtaacccggcatccagaaccttctccgtaggggccttgcctgggactacaactcccaggatgccgcaggcggagaagctggccaatcagggggcgcggcttcgccttcaccgtcggctccctgctcctgtcagaacctcggtgacggttggccaggtgggtagtgacggctgctcggtcttgaaggatcctaatctggtttgggagggtgaagaccgctgaaatttccaggctgcccgaggctccaccttccaccacccaacgggtgggcggtgggccgggctggcctcggagcctctccctgggtgtcggttgggccgagaaggggacggttggctgggtgggcctggcggctggtggctgtccgtaggccggggtcactctgagggcattttacattaccctaatcctgtccacttggcaagaaacttagtaagccccaaaggttcattccaaatcctgtctgggagggcgaggactgtggaaacttccagatgcctcaggctccatctttagctgttgagcgggtggttgggccgctcatggccccaaagatctggggggtcttcatgggcagttgggtcgctgagggccctaaagatctggggctcctcccaggtgtcagttgggccaaggaggaggctgggctttcagagtagaacctgcggtgctaacgatggctctgcagggctgcgggctgagggcctgggcggcgtcctgtggcccggagatggcgctctagtggtatcaggccttgagtcagcgacatcctggcttctgaccccccattcctatggcccctacagtctggtctccgcttccccactcccggtgaattgctgttggagcagcctctcctttctgggtagtggcctggccgagctccccggggagggcttgacccagacctgtcctgcctccagtccagtcccagctacattgttgtgtagcaccccactgtgccctcaccccacccacgcgctgggtgctcgagggcctaggagaaccagagtggagagaggccactgtcttgggctctaaaatcatttagtttctactttactatttttaaaaaacttttgccttgtttttgaagttctttaattccaccactccaccccttgttaaaatatcatctttctttttccctgcaacttgactcttggtttggcatgcccaaggaaggcagctgacatcctggagaatggggtcttgggggtagatgcaaagcgcattttattaatgtctgggaaacaaaattagtttttttacagtggctctgaaatgagagaaattgcagaaattctccctgctcaggaaaaggtagaggcaaggattgacttaaagatgggtaagaagcgtgttactgatcataagctaaatgtggacaaagtaattaaaaatattaacacaatttcttcggagttgaagaagataaaagagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaacaa

SEQ ID NO: 1850 - DNA, 509 bp, Homo sapiens
cgcggcttcgccttcaccgtcggctccctgctcctgtcagaacctcggtgacggttggccagtttttttacagtggctctgaaatgagagaaattgcagaaattctccctgctcaggaaaaggtagaggcaaggattgacttaaagatgggtaagaagcgtgttactgatcataagctaaatgtggacaaagtaattaaaaatattaacacaatttcttcggagttgaagaagataaaagagctctcccagttattgctttgtgaccttatcctacattttaatcatcccatcaagactgagaacttagcagaagcagaaagaaacaaccccctctttgaagagtctaaaatatcagatgtatcccttgtttctaacagtttttctatctgatttcttatttgttatgagtttctgttttattgttgaactaacaaatatttgggagagttgagtttactaatttgtatatatataatttaaaacaaaataaaaataatgtaaacaagc

SEQ ID NO: 1851 - DNA, 1208 bp, Homo sapiens
ggccccaataacttgtcccagaggggatgcccagggctcagttgcctgaggacagcagtgcagttgacatggatattctctttcctctggacagtgttattggtacagagctgtgccccagccccattccccagatcatccatttcgtcctctttgttgtgttcagcctggtgatcctgattatcttacgcctctacattcccagggagccgtcctcagtgcctcccagagaggaggacagcgagaatgatcaagctgaagtgggggaatggctcaggatcggaaataaatatatcactttgaaagattacagaattctcttgaaagaactggagaaccttgagatctacactttcctgtcgaaaaagtgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccgtagagtccttggggtctccatcatccctgagctcctccaagccacgagagcctctgtgtcccctgaagcacccttcacaccagccacctgcgagcaccctatcaccaaacccgaccagctccacagaatccttgggggagaccccacatgcaggcaggtggaggcaggggtcccgctttcctcagcctggatgtgccaacgctgctggacgcataagacaccaaaatcccagacactcccatggacaccgaatatccgacatccacgaacaattgggaatctcctgaggacaacttggagatggagtctcactctgttgctcaggctggagtgcagtggcaccatcttggctcaccacaacctccgcctcccggattcaagccattctcctgcctcagcctcccgagtaactgggattacaggcttgtgccaccgcacccagctaatttttgtaattttagtcgagagaaggtgtcaccatgttagccaggcttgtcttgaactcctgaccttgagatatctgcccacctcagcctctcaaagtgctgggattataggcttgagccaccacggctggatgaatcataaattgtaaacctgaataaaatgctgcaacctccaatgagaggaaaata

SEQ ID NO: 1852 - DNA, 966 bp, Homo sapiens
ggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacaggttcattttacaggaggtgaacatcacacttccagaaaactctgtctggtatgaaaggtataaatttgatattcctgtctttcacttgaatggccagtttctgatgatgcatcgagtaaacacctcaaaacttgaaaaacagctcctgaaacttgagcagcaaagtactggaggctgactgatgccctcatgattttccaccctctcttcccataaagcatcttcctaaggaaatgaccatggcctgatactcattttgtcacttgtacagagccctaaggatgttctgaattcagtggtgccaaataaatgttgacattccccttttggttgatggaagtatcagtgtgggaactgtttgcttaatggcattttataaaataagaagagcatattagcagggagggagatgatggagggagggagaagtccatttgtcttatttatcctttttgtattaatagagaagcacttcacagtcactgggcaatgccatttataggaagaaggttctgcattcctgctgctgccccggagggcttaactttttaatgaaagaataaatgctcttccactcagtagataaagtgaaatgtgaattgttaataactgtgcacggtcaataaagcgatgttttaaggaata

SEQ ID NO: 1853 - DNA, 5680 bp, Homo sapiens
ggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacaggcaaccctacaaggatcagaagctgccaggaacaaggagaagacgctccccttcctcaccttcccacccccacatggcttctcagtcggggaaaagatacaacttaactttaaaccaagtcttaagttttgattatgacatgggattagatgcaccaaaaacaatttcaagtgactgtggggcattctattgcctgagaatgttcaagagtcctgatatgacctgttgtttttatcctaaacagtgaaaaattcatccaccaaatatataggaatagagggagacagaaagatgctttctgaaggtatcccatatttagagtattggttacatatacctaatgttggttttaacctatagctcttcaataaacttactcatcaattcttatttcagagaggaatatggtcatgtgactaggaatcctgcagatcttcagcaaacccatgggtcccaacagctggcaaaatgaaaggtagatacctacaaacatggcatctaaaaggtggtttgattatcccactgtcaagtatcagtgttatgtcacctattactgtgattttcatgtgatgtttgtagcagcaattacttttcctttctgaaattatgtttgcaaagatcaatttgtttttatataaagattaactttgatataagaagctcatcattcacctccaaaggaaaaggtgatacaagcttcctttttttcccccttcaagctaatgccttatgaaggagtggaatagtttgggacttcatattgctgctctagaatagtgcctctttcttccacatgtctcttcataacattatgagcttactggaacacatagctctttggccagtttattgcacgaaacaagggtatactcagactggggttttttaaataatgcagcaatctcatggacatctgacagtaggaatcacaatacagccaggcttcagaagtacaattaaagaaccacccaaaactgaaacatcacccttctcacagtgccttggcttattttcttccttgttctctcctggctcacagctcccctgcttacacacactatctgcttcctcatagctgcagcctgcttatgcccatcattactgctaacctttctgttcagcaatacagcaccctgagcctctcaggcttctctattctgaaatcctaaaaggaattttactcagcttatattttacaaccaggcacccatgacctaagttggctgaccaaatctatagaaggagccacctttaggacagaagcctatccctgggccaactggctatggaagcggtatgcaaatcacagtcactgcccactggcagaggccagaagcaggacaggcaatgaccagcaactctggcacgcctccaaaaagcttaagaatgtgacattctaccatactcaagagaagtcaggagggacacattggtaagttcacttatatcctactccataggagtaataaggacatgaaccaaagcaatgggagtcagacagaaagagatatcaggagatatttaggagtgaggttgacaaaacttcatgactgactggatgggtcggtagtgatgtggagaggggagtagagagaaagcatggattctgggataactcccagttttcttgcttacactactgggtgaattctgatactttttattccctgaggcagagaatgtaagaggaaggaaaagttagttttgggctgtgcttggtggatgggaaaggtaagacatggtgaattctccatgcttgtgggatatcaaggtaaagataaaagttagaagtgcaaaacaaaggtctggggttaaggtatacatttgagagcccactgagtatggttggaaatgtggccacctggcatataaggagaaaagcaagctattcccaaaccatggagaatactaatcttgacccatgagaatagaggaagttgctagtgaaggaaaatgagagagtggtggtggaactaggaatgggagaagctcatccaatttacattacgtgatgccttttgtgatttgatagtggcaggtattattccaagcactggggataaaacaacaaacaagatagccaggattcctactctcagagtcttgcattttaagggagagacagacaataaagatatcgtatcagaggaaaataatcatgaaagtcagggaggagcttttcccagagtaactgacagtatcaaatagcaagagagttaggatgaggactgaacagaagacatcagatttgaaaattagaaaatcagtgctgctataggaagaatagtccccaaagatacccaggtcctaattcctggaacctgtcacttatatgcataaaggactttgcagatttaagttaaggatcttgagatgggaaaattatattgcattatctaagcaggtcctaatgtaatcacaggtgtctctataagagggagtcagaaggagatttgactagggtaaagagagtaggaaattcgacaatggaagcaaaaggttggagtgatacaagaaagcagccatgagccaaggaatgtgaatggcctccagaagctaagaaaagaaaaagaaaacagattatcccctatagcctcccgaaggagcaagccctgctgacacgtttactttagttctgtgaaactgatttctgacttctggcctatagaactatgagagaataaatttgtgttgttttaagccaagtttgtgataatttggtacagcagcaatagaaaatgaatacaaatgtttccttgaccttattgagaacaacttttgtggagagggaagaggtaaactaaaagaaaattgtggtgggatgataactgaaagatacagaaaagacagcaaagtatccattttttaggaagtttttatatatctcatttgacccactaagaaacgacatccagaaaggagctaaagaccagaggtaattgattagctcagcacccaaaaatggcaggcagtgttggggcagtactagaatgaggtagccggccgggcacggtggctcatgcctgtaatgccagctctcagggaggcaagaggtgggagtatagcttgagcccaggagttcgagacctgcctgggcaatatagcaagaccccgttctccagaaaaaggaaaaaaaaaaaaaaaaaagcatagaatgaggtagccataacattctacctggcttttggctgaattgtggggaggagagttcagaggcctcaaaagtgaccctgacactggagagtaaaccatagtaacccattatagtccacagatatgcgcaccagacccatgactcttgttcaccatagagacaggatactttgatgctgtgacccaaaatcctgcacctggaacagatttggtacctctctattgacacagaaattcatgttgagcatggagacataatcaagagagaatggcctcattcgatcggtcttcagcttaggcactgacattttgcattttacctcctctctcaggttcaaagatgactaccaaagctaaacctctgaattctaaagtctacaaggacataaagcttcagggaaaggggaaatattaatattaatattaatgtcatacaaaagaggagaagcagcacataggagtgccagctaatagactagtagtaataagaagaatccaaccataggcctatattgagagtcatgggcatcccttctttatgctgaaatggtatatttgaacggaattcctgatggaaaactttctatccttagaaatactgtaggccaaatattaattggaacttttgttaatgatttgagaacaccaaaaagtttagatgatacaagttaaaggcaaattgagcccatggcctcattgtgctacttagaataccctgtgacccagctctcctcagaaaccctgatggctttgttgcagcattgcattgcacagaagacctcagtggtggtcctgagtcctcacaacaaggtcaacccgtggcctggccactaaggcaacagagagggaaataaattttagaaaacgcttcccttaaaaatgagttaaaatgtacatttgcatcatgagactaggttaactgtcacctgagaaagtcctatattcagaaagacttaatcctggaccaggtaaatgaggcatttgctgtatgttctttgttatgaatttaatgctacaaagagaaaatgggcattgatgcataatctgggtaaaaaagagatgtcagaagttgggaaagaactgccagaagagctatgttttaggatttcactccaccttaccctgtgttttcttgtaaagatattctcaaaattaggccaatttcactcttttaaggtcagaggagattaagatatttagaaatcagattgtgggattgattcccattgtgattgctgacttttagtatcagccttttgttctgcatggattctctcatcttgcaaactagcaagactcctgaatttggcaatgatcctgctctgtgaagcattctcaagttagggttcttatcaatgtcagatttcactaagccagtaataaaggaaaggttgagagagcaaaggatgtcactgagttgacacctaacagcacaaaacaacttgtcagctggcaggacaagccagcatgttcagggtggtcacagcctttgagttggaaagatagtcttttaaacattcttacctcaccaaataactttaatagataaaatttagttactccctcccacttttgttctattcatttaaagcagtgttttttaaaaatttatgtatatgtgactacatgaaaaatacattactgtgtttcttgatgttttatgacctgtacacaaagtgagaccagcagatgccttcaagagaaataaaggacactgctgtcattctaactaaattgtccagaggaggaaagaagagtacaaaaatgattatgaatacttaagaagaggcatgactttgtcattggtgtggagcctataattatgtgcaattccctacttaagactttttagttatgctgaacattgaaaaaaaactaaacagcggagaggagaaaagaaaaggggaaatttaaacatttaatggaacacattcattaaatggagacatcgcttcaccataagggggcagttaagggtttggtagtcctactcacttgctattgtcaaatcatttgttttatcatggatttgagatccttataagtcttcattattattttgaattcaagaatgattccttctgctcacaaaacatgatcacttttcattgatttttttttttaatattctgactggttttgcatatctggaaaagataaatcttcaaaatttggaaataaatatttttcctccctgccaaatcca

SEQ ID NO: 1854 - DNA, 3251 bp, Homo sapiens
cggccgctttaaggcgcggtgacccccacggcatcctcgggcggggcggggacagtgccggcgccaccagcggaggcgaatgcgagggagatagtgcacggcgtccggccccaccatgctgaccgcgctcgccccgccagccctgcctgggatcccgaggcagctgcccacggcccccgcgcggcgccaggactcctccggttcgtcaggctcctactacacggctccaggttctccggagcccccggacgttgggccggacgcgaaaggcccagcgaattggccctgggtggctcctgggcggggggcgggcgcgcagcctcgcctgtccgtcagcgcccagaatagccgccagcggcacgggcccggctcgggtttcccgcgaggcccaggttccggcccacggccaccccagccccagctgcgcacgctgccgtcgggggagatggaagtcatcttcggcgtcggacccctgttcggctgctccggcgcagacgatcgcgaggcgcaacaacagttcacggagccggccttcatcagccccttgccgccggggccagcgtctcccgccgcggtcccacgccagtcccaggtccccgatggtggctcccgctgggccacctacctagagctgcggccccgtgggccaagtcctgccgccccagcgcagttcgagtgtgtggaggtggctctggaggagggcgccgcgcccgccaggccccggacagtgcccaagcgtcagatcgagctgcgcccccggccccagagtcccccaagggcggccggcgcgccgcgcccccggctgctcctgcgcaccggttccctggacgagtcgctgggccccctgcaggccgccgcgggcttcgtgcagacggcgttggccagaaaactgagccccgaggccccggccccgagcagcgccaccttcgggtccacggggcggtcggaacctgagacccgggaaacggcccgcagcacccacgtggtcctggagaaggctaagtctcggccacttcgcgtacgagataattcggcccccgccaaggccccgaggccgtggcccagcctccgcgagcgcgcgattcggcgcgacaagcctgcgcccgggacggagccgctgggtcctgttagttccagcatcttccttcagtcagaggagaagatccaggaggcgcggaagactcggttcccgcgagaggcgccggatcgaactgttcagagggcacggagtccgccttttgagtgtaggatcccctcggaggttccgagtagggctgtgaggccaaggagcccgtccccgccacggcagactccaaatggggctgtacggggtcctcgctgcccgtcgccccagaacctgtccccgtgggatcggactactcggagggtgagtagcccattgttccctgaagcctcctccgagtgggaaaatcaaaatcctgccgtcgaggaaactgtcagcaggagaagcccttcccctccgatcctttcccagtggaatcagtgtgttgctggggaaaggagcccgtccctcgaagccccttccctgtgggagattccacattcggcagtcgcggatgcggtggagccacgtagcagcccgtccccgccggccttcttcccgtgggaggctccagatcgtcctattggaacttggggcccatctccccaagagacatgggatcccatggggccgggctcatcgatagcatttactcaggaagctcagaatgggttaactcaggaggagttggcaccgcctacaccgtccgcacccggcactccagaaccaacagagatgcagagtccatccacgcgggaaatttcagatcttgcctttggagggagtcagcagtccccagaggtagcagcacccgagccgcccggcagccaccctgtgggcaccctggacgcggataagtgcccggaagtcttgggtcctggagaggcggcctcgggacgcccgcgcatggccattccgcggcctcgagacgtgcgcaagttggtgaagaccacgtacgcgccaggcttcccggcaggagcacaaggctctgggctgcctgcgcctcctgccgacccctgcggggaggagggcggcgaatccaagacgcaagagccgccagcactggggccccccgccccggctcactacacttccgttttcatcaaggattttctaccggtggtgccgcacccctacgagcctcctgaaccgtccttcgacacggtcgcccgggacgcctcacagcccaacggggtcctgcggcggagggcagagaacagcacggcgaagcccttcaagcgcacagagatccgcctgcctggggccctggccttgggtcgccggcccgaggtaacctcgcgagtgcgagcgcgcggccctggaggagagaacagggatgtagaggcccagcgcctggtccccgacggcgacggtcggaccagccctctaggcggcgcccgcagctcatcccagcgctcccccgtagggccagcaggggtccgatcgccccgccccggctcccctcagatgcaagccagcccgagccctgggatagcacccaaaccgaagacaccacctacggcccccgagcccgcggctgccgtccaggcgccactcccgcgggagcccctggcgttggcgggcaggacggccccagcccagccccgcgctgcctcggcgcctcccacggaccggtccccgcaaagcccctcccagggagcgcgcaggcagcccggggccgcgcccctggggaaggtcttggtggaccccgagagcggccgctactactttgtggaggcgccgcggcagcctcggctgcgggtgctcttcgaccctgagagtgggcagtacgtggaggtgttgctgccgccctcgtctcccgggccgccccaccgcgtctacacccctctggccctggggctcggcctctacccgcccgcctatgggcctatacccagcctctctctgccaccgtccccgggcccgcaggccctcggcagcccccagctaccctgggtctctgaggcagggcccctggacgggacctactacctgccggtgagcgggacccccaaccccgcacctcctctgctcctctgtgcgccgccctccagctcaggtcccacccagcccggcaagggttcattgttcccgctgtgaggccccgggccgatccccatggagttggagcccttggatgcctgggaggttctggcatccaagcccctaccctcctctccttccgtcg

SEQ ID NO: 1855 - DNA, 2173 bp, Homo sapiens
tcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1856 - DNA, 2148 bp, Homo sapiens
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1857 - DNA, 753 bp, Homo sapiens
ctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaa

SEQ ID NO: 1858 - DNA, 778 bp, Homo sapiens
tcccatcatttgcttaggtctgatcaatctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgtcagatcgcatcctcacacaatcactggtccaccttcagcaccccgcggtccacccatggcacccataataatttcacagagaaccgcaagtcagctggcagcacctataa

SEQ ID NO: 1859 - DNA, 778 bp, Homo sapiens
tcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgtcagatcgcatcctcacacaatcactggtccaccttcagcaccccgcggtccacccatggcacccataataatttcacagagaaccgcaagtcagctggcagcacctataa

SEQ ID NO: 1860 - DNA, 2173 bp, Homo sapiens
tcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1861 - DNA, 753 bp, Homo sapiens
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaa

SEQ ID NO: 1862 - DNA, 2173 bp, Homo sapiens
tcccatcatttgcttaggtctgatcaatctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctttcaagctctctcaaaaaaccattgtgcaaactctaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagcagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1863 - DNA, 2148 bp, Homo sapiens
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1864 - DNA, 2148 bp, Homo sapiens
ctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctttcaagctctctcaaaaaaccattgtgcaaactctaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagcagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 1865 - DNA, 2173 bp, Homo sapiens
tcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttcataagttaagacgtatatgattccgtcaagaaagactggatactttctgaagtaaaacattttaattaaagaaatatatagtaa

SEQ ID NO: 1866 - DNA, 2148 bp, Homo sapiens
ctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttcataagttaagacgtatatgattccgtcaagaaagactggatactttctgaagtaaaacattttaattaaagaaatatatagtaa

SEQ ID NO: 1867 - DNA, 2076 bp, Homo sapiens
acacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttcataagttaagacgtatatgattccgtcaagaaagactggatactttctgaagtaaaacattttaatt

SEQ ID NO: 1868 - DNA, 466 bp, Homo sapiens
tcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccagggaaggcggtacatctacgaaagccctaatcatagagggaaagactcctcgttcctggcccagaaatgagatgagaaatccagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatca

SEQ ID NO: 1869 - DNA, 466 bp, Homo sapiens; identical to SEQ ID NO: 1868

SEQ ID NO: 1870 - DNA, 466 bp, Homo sapiens; identical to SEQ ID NO: 1868

SEQ ID NO: 1871 - DNA, 466 bp, Homo sapiens
tcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccaggaaaggcggtacatctacgaaagccctaatcatagagggaaagactcctcgttcctggcccagaaatgagatgagaaatctagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatca

SEQ ID NO: 1872 - DNA, 466 bp, Homo sapiens; identical to SEQ ID NO: 1871

SEQ ID NO: 1873 - DNA, 466 bp, Homo sapiens
tcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccaggaaaggcggtacatctacgaaagccctaatcatagagggaaagactcctcgttcctggcccagaaatgagatgagaaatccagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatca

SEQ ID NO: 1874 - DNA, 1415 bp, Homo sapiens
atgcatgaacatgccacaccagtgacctcagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactct

SEQ ID NO: 1875 - DNA, 4854 bp, Homo sapiens
tctttgctcagagctcagccctacatagatcggcttctgccatggcctccaaacaaaccaaaaagaaagaggtgcatcgtatcaactcggcgcacggatcggataaatcgaaagatttctatccttttggcagtaatgtacaatctggttctactgaacaaaagaaggggaaattcccactctggccagagtggagtgaagctgacataaattcagaaaagtgggatgcaggcaaaggtgcaaaagaaaaggacaaaacaggaaaaagccctgtatttcatttttttgaggaccctgaaggaaagattgagttaccaccatccttgaaaatttattcctggaaacgtccacaagatattttatttagtcagactccagtagttgtgaaaaatgaaatcacgtttgacttattttcagcaaatgaacatttactctgcagcgagctgatgagatggattatcagtgaaatctatgcagtgtggaagatcttcaatggaggaattttgagcaattattttaaggggacttcaggggaacctcctcttctcccctggaagccctgggaacacatatactctctgtgcaaggctgtgaagggtcatatgcctttgttcaatagctatggaaagtatgttgtgaaactttactggatgggttgctggagaaagataacaattgatgactttttgccttttgatgaagataacaatctattgcttccagctacaacttatgaatttgaactgtggccaatgcttttgtctaaagctattatcaagctggcaaatattgacatccatgtagcagacaggagagagctgggggagttcacggttattcatgcgctcacaggatggttaccagaagtcatttctcttcacccgggatatatggacaaagtttgggagctcctgaaagaaatattgcctgagtttaagctgtcagatgaggccagctctgaaagcaaaatagcagtgttagattctaaattaaaagaaccagggaaagaagggaaggagggaaaagaaataaaggatggaaaggaagtaaaagacgtgaaggaattcaaacctgaaagttctttgacaacactaaaggctcctgagaaaagcgacaaagttccaaaggagaaagcagatgcaagagacattggaaagaagagaagcaaagatggagaaaaagaaaaattcaaattctcacttcatggttcaagaccctcatcagaagtgcagtactctgtgcagtccctatcagattgttcttctgcaatacagacctctcatatggtcgtatatgcgacatttacacctctttatttgtttgaaaacaagatcttttcattagagaagatggcagattctgctgagaaacttagagaatatgggctttcccacatctgtagccatcctgtgctggtgactagaagtaggtcttgtcctctggtagcaccaccaaaaccacctcctctacctccctggaaactcattcgtcaaaaaaaggaaactgttataacagatgaagctcaagagttaatagtaaagaagcctgaacggttccttgagatttcaagtccatttttgaattatagaatgactccatttacaattccaacagaaatgcattttgtgcgctccttaattaagaaaggaatacctccaggatctgatttaccttccgtcagtgaaactgatgaaactgcaacacatagccagacagacttgagtcaaataacaaaagctacatctcagggaaatactgcttcacaagttatacttggaaaaggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtagatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacagcacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaattaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcatttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactct

SEQ ID NO: 1876 - DNA, 5325 bp, Homo sapiens
gcaacgcagacgcggagccgagcgcgcccgcaggctctttgctcagagctcagccctacatagatcggcttctgccatggcctccaaacaaaccaaaaagaaagaggtgcatcgtatcaactcggcgcacggatcggataaatcgaaagatttctatccttttggcagtaatgtacaatctggttctactgaacaaaagaaggggaaattcccactctggccagagtggagtgaagctgacataaattcagaaaagtgggatgcaggcaaaggtgcaaaagaaaaggacaaaacaggaaaaagccctgtatttcatttttttgaggaccctgaaggaaagattgagttaccaccatccttgaaaatttattcctggaaacgtccacaagatattttatttagtcagactccagtagttgtgaaaaatgaaatcacgtttgacttattttcagcaaatgaacatttactctgcagcgagctgatgagatggattatcagtgaaatctatgcagtgtggaagatcttcaatggaggaattttgagcaattattttaaggggacttcaggggaacctcctcttctcccctggaagccctgggaacacatatactctctgtgcaaggctgtgaagggtcatatgcctttgttcaatagctatggaaagtatgttgtgaaactttactggatgggttgctggagaaagataacaattgatgactttttgccttttgatgaagataacaatctattgcttccagctacaacttatgaatttgaactgtggccaatgcttttgtctaaagctattatcaagctggcaaatattgacatccatgtagcagacaggagagagctgggggagttcacggttattcatgcgctcacaggatggttaccagaagtcatttctcttcacccgggatatatggacaaagtttgggagctcctgaaagaaatattgcctgagtttaagctgtcagatgaggccagctctgaaagcaaaatagcagtgttagattctaaattaaaagaaccagggaaagaagggaaggagggaaaagaaataaaggatggaaaggaagtaaaagacgtgaaggaattcaaacctgaaagttctttgacaacactaaaggctcctgagaaaagcgacaaagttccaaaggagaaagcagatgcaagagacattggaaagaagagaagcaaagatggagaaaaagaaaaattcaaattctcacttcatggttcaagaccctcatcagaagtgcagtactctgtgcagtccctatcagattgttcttctgcaatacagacctctcatatggtcgtatatgcgacatttacacctctttatttgtttgaaaacaagatcttttcattagagaagatggcagattctgctgagaaacttagagaatatgggctttcccacatctgtagccatcctgtgctggtgactagaagtaggtcttgtcctctggtagcaccaccaaaaccacctcctctacctccctggaaactcattcgtcaaaaaaaggaaactgttataacagatgaagctcaagagttaatagtaaagaagcctgaacggttccttgagatttcaagtccatttttgaattatagaatgactccatttacaattccaacagaaatgcattttgtgcgctccttaattaagaaaggaatacctccaggatctgatttaccttccgtcagtgaaactgatgaaactgcaacacatagccagacagacttgagtcaaataacaaaagctacatctcagggaaatactgcttcacaagttatacttggaaaaggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtagatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacagcacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaattaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcatttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtctagcaagcacattctttcatttcactctgcatccaagaaagagcaagaagtgtatgttaagaagaaagctgctcagggaattcagaaatcccccaagggtagagctgtaagtgcaatacaagacattggtctaccccttgtggaggaggaaactaccagtacacccactagagaagacagttccagcacaccactgcagaattacaagtatattatacagtgttcggtgttgtataacagttggcctctcactgaaagccagctgacatttgttcaagcactgaaagacttaaagaaaagtaataccaaagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactctaaa

SEQ ID NO: 1877 - DNA, 305 bp, Homo sapiens
gcaaagcactacctgaatgtagatttgggccatacgttggaaaataagacatgagagtatgctccgatcaacttttactgttcactggacaactattttgggaatttgcagacctataaagcccatctataaatctcaagcatgtccactttcagagaagagaaatgctgacaaccatttagtctctgaggacaacacttttaaagtgtaacaatgtggcatccagagcttatccagatgagcggagagcaaatgaatttccttctgctcccctgttgaagaggagagaaaaattcttcaagctg

SEQ ID NO: 1878 - DNA, 1716 bp, Homo sapiens
ggcctcctgctgcggaggaagagggggaagaggccgcgcgggagggacttctgacacgcgccactgtttttgttttcaaacaggggtacttaaccgaaactagcaatcccaggcggtacaaggccctccatcgtaggcaaagcactacctgaatgtagatttgggccatacgttggaaaataagacatgagagtatgctccgatcaacttttactgttcactggacaactattttgggaatttgcagacctataaagcccatctataaatctcaagcatgtccactttcagagaagagaaatgctgacaaccatttagtctctgaggacaacacttttaaagagccagaaaggtacatttcctcttcatgtgttctcacttccatcctttacctcggtgaaaagacgttttccttccgtacactcatcagtccaagagggatgaagcttgtggaaattttgcagcagccttccctgaccatggtggcctgaagtgcaccttttatacaggactccatcataggactggagagagattggatgtcagagtgattgatgtgctcctactggaagaaggcaaacatccatatgtgaactgcctgtggggtttccaaggaaaggaacggcaggcagcctctatgagcttaaagaagataactgggactttagtcctataacctcaaggaacagtattctgtgaaccatctgagaagcttggaagaggaccccaaactccaaataagaagctcagtgtgtctgacaccttgactgcaggcttgggaggtcctgagcagaagatccagttcaacagtgcctggactcctgatccacaaaaactgataacaaatatttattgttttaagatgctaagtttgtagtcattttttatacagcaacagaaaactaaacacacacataaacagttataagtgctcactgtatatgaggcttttcattaataatctatattttataatagaattagaatatagatctgtgaagctgaagacactcaatccttgctagatttaaatcaggaaaatcagctgagaatcattccttgatagaacctggaaaacaagaccctatgagagaccctgggaattacattaaattcactgtggttcccagtgtcactgaagaggttttcctttcatagtcaggtagtcaccatactgttaagcatttgaacacatgggcaacttccagaatagttatgacattgatataccaatctccaaaattcctagaataccatgttttcatggttgaccttcaaatcagtcagttctttgtaacattgagccataaagatagggcaaatacttaatgttttacatatattcagagattgaccctcaaaatacagcccagagaaactcaaaagaattaactctatttcttcaaattgtgtgacgccaccaaggccagatgacttcagcattgggaaggcaatatccagctgtcatcttcttgatcctcatatgctactactagcatctagcatttactgagcagatagttttattgtccagtttttaaagataagaaaattgaggtattaggaaagttaagttggttgcctagggaaacacgaagatatagcccagattcactcccaggcaggcagatgccagtgtctgctctctttaccaccgaaatatcctgctacatgtacaatttcaataaatatctggacttactggaacaaaacaaa

SEQ ID NO: 1879 - DNA, 845 bp, Homo sapiens
gggcggcccctttcttgagcgcagaaacacttacttttccccctaccctgctcctcctcctccacagccgtctttctctttgcctcagccacttccttccttggcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaaattt

SEQ ID NO: 1880 - DNA, 456 bp, Homo sapiens
agttctccggcgggaaggaaaaccgcgcagagaggcagcaatgaatgtggatcacgaggttaacctcttagtggaggaaattcatcgtttgggttcaaaaagtaagtatctgacagagatagagtatttctcctggctttaccttggaacaggtgagactggcatgctggagaagcctatgaaggggtcacccagggcttcaggacacaggtctgggagctctgcccacagccccaggttataactgcccttagccaggaattgacatctggagacacggggcttttggggtattgtgattctgatgcagggaatagttgagatatttcattatttttcgatagaaagcaaattaccaagcttcttgtatttgactgcattgaaatttggtaattgaatcatgttcaaatttttacttgtcatactattaaaattcatgttttctgccttgttctg

SEQ ID NO: 1881 - DNA, 1812 bp, Homo sapiens
gcagctggagggaaggaagcgatggcggaggagcgggagcctgaattgtacctgaagtggaagcactgcgagacgccaggcgtgaagaccctgtgtaatctgaagcactgcgagacgccaggagtgaagaccctgtgtaatctgaagaaacttctgaatcggcttcagaaagaccaccgggaggacgtctacctctacatctctggacacctgaaccccaacaagctctaccagcctccggagacgatcttacagcactggcccaatgcccaccggcccaagggggagcgcgcctctgaggtgggagagccgcccgcagggaaggtggcgaggatgaaggaggccctggcccacttcaccatccacacggccctggtccccagtgaggcccaggacaccccgctgttcaggtacctgaacccccaggcctctctttcccacacttcagaggaggatttccttccagtggaggctgtcagagaggggaaggaagaaaagaaaggaggccctcctggacggggccctcctggatggcgcaggagggaagaactccggctgcccgacttgaaggtgctgtgctaccaggaggccgggtccagaggcaccagggaccggcaccactatgtcagctcctacctggccggagccaccagcgcagacaggtacaggatgttcctgcgtttccagaaggaagtgctcgccaagcaagatctcctgaagaatgacttcactgggagcaaggcggccgcgggccacgagagaaagctgcagcaggagctccagaaaatttgcacgtgcagcccccagcagttcaacagactgcacgtctttggaaaagtctttgaagatatttgtaacagttctttgatatttggtgatctcttgaaaaaagttaaggatgaatatgaactctacatggcaacgctcctggagtcccagcctgcagcacagtacgaggctcttctggctcaactcaaggcgctggggcagaggccggtgaagacggcggacatggatctcgccagggaagagctgaggatgctcgtgacagccacaaaagcagccctggagcagaatgatagactcagaagtgaactggagatggaggtggcattgctgcagtctgcaaaggaacgatcagaatcatctgagaaacatataattgatgaaaaccgacttactcttactgagaaggttgaaaagaagaggtgtgaaatactcagtaagtgggatgagatacaagctctggaaaaagaaattaaaacaactttggttcatactggaatttcagatatcactgagaataggattaaaagcatagagcatgaagctatacaattggaaacagaaaatatgattttaaagaagaaaataaaagggcctttggaaatttatcaaggaatttgtaaaatcagaggaaacagaagataacgctcaagtggctgaacaaatggccagtggaaattcttaacttccatgtatgtagcatggatatttgcagatgcatatacattcataaagatacatttcatttcatcagctttaatctctagtaaaattaatgtggtatatgtatcctactcaggatactgaaatacacacatgcgtacacatgattagtttctgttgcatacatatttacaacaatactagttcttaacgtatgttttactttcatttaataatgttcaactttggaaaatacttttgattatttgctaagaataaggaattcagcgctgcttgaatacagctcaaatttgtttatttgccaacacaagtttacatatatgcatttaataaaattttata

SEQ ID NO: 1882 - DNA, 1838 bp, Homo sapiens
agaatgcatttagtgctcttcatgtacaggtgagtgggcaggttgagagcgtggtcttggaggcagctgaccatctgaccacctgaacctcagtttcccctcctgtaaaggaggatgggacggcgcctacctcctgggctgttgtggggattgaatcagcatgccgcacaccggctgtggaatagacagtgggagtcattttaaaaaggggtctttcagtccttggggagttgtcttttctcttctttgtatacaaagagcttcaggctgtcaccaggctggactcgagggtaagtgtacctgaagtggaagcactgcgagacgccaggcgtgaagaccctgtgtaatctgaagcactgcgagacgccaggagtgaagaccctgtgtaatctgaagaaacttctgaatcggcttcagaaagaccaccgggaggacgtctacctctacatctctggacacctgaaccccaacaagctctaccagcctccggagacgatcttacagcactggcccaatgcccaccggcccaagggggagcgcgcctctgaggtgggagagccgcccgcagggaaggtggcgaggatgaaggaggccctggcccacttcaccatccacacggccctggtccccagtgaggcccaggacaccccgctgttcaggtacctgaacccccaggcctctctttcccacacttcagaggaggatttccttccagtggaggctgtcagagaggggaaggaagaaaagaaaggaggccctcctggacggggccctcctggatggcgcaggagggaagaactccggctgcccgacttgaaggtgctgtgctaccaggaggccgggtccagaggcaccagggaccggcaccactatgtcagctcctacctggccggagccaccagcgcagacaggtacaggatgttcctgcgtttccagaaggaagtgctcgccaagcaagatctcctgaagaatgacttcactgggagcaaggcggccgcgggccacgagagaaagctgcagcaggagctccagaaaatttgcacgtgcagcccccagcagttcaacagactgcacgtctttggaaaagtctttgaagatatttgtaacagttctttgatatttggtgatctcttgaaaaaagttaaggatgaatatgaactctacatggcaacgctcctggagtcccagcctgcagcacagtacgaggctcttctggctcaactcaaggcgctggggcagaggccggtgaagacggcggacatggatctcgccagggaagagctgaggatgctcgtgacagccacaaaagcagccctggagcagaatgatagactcagaagtgaactggagatggaggtggcattgctgcagtctgcaaaggaacgatcaggcaggtgtctgtgtgatgtccttccttatgggtgctttgctgtgaccttcattatttcagctgctgcagtgtggctgcctgtctgtcaacttggaagatgctgatgctccctctgagttttgttgcgagaattcaacatattcacccacatcacccaagatcacagggcctggcacgtggtggtgactgcctgtttgttcttcatcttttcattattacataatcatctgagaaacatataattgatgaaaaccgacttactcttactgagaaggttgaaaagaagaggtgtgaaatactcagtaagtgggatgagatacaagctctggaaaaagaaattaaaacaactttggttcatactggaatttcagatatcactgagaataggattaaaagcatagagcatgaagctatacaattggaaacagaaaatatgattttaaagaag

SEQ ID NO: 1883 - DNA, 1173 bp, Homo sapiens
aggacacgtggaaacgcaaccgccaggaggaaaggcgggacacagcgggaagggaggtttgcctcccctctcttcctgtggtgacccccacctcacttacaaaaatcaccaccgacgtttgggaaccgtgcacgccgactgaaagcaaagctcagctgacctgcgaggagtccccggggagctgccgcggtggtcgccgttgagtccgtccgtgccgctggggccgaggcagctggagatgtggtcaacgggctgatgggcacggctgtgggaccccatcattcccctgccccgcatgactctgctctcccagctcgactgctcacttcagacttcccttatggaaggagttgccagatagagcaagtaaaatacagtgtgccagacacaggtttatttcaacactgggaaggctccattcctacttaaacccagcagggaacagggagcggtgtgcagaggaggtggcctgcccgggaagccggccttggtgctgggactgcagggagagggctgtgaggaagagcacaggcttcatgcacattgcacagaggaggagattcatggggacagcaggcactggttaggcacagcgggaaggttatcgaagacaaaacacatttctacccaagtttaaatgacctgctatgcccacagagcttgatccagaagtgcacaggtaagtatttagcaggctggccgatgttgatttgaacaatctcaagaatgtgctctttagtgcattaaacatatgtgacgagagctgagcacgtttaaaatctcagtaactttggggtttgtaagtgttgtagctcatagtgtcggttaaggttagacatctcagtcacatgctgtcttggcaccagctgtggactgtgctgtgaaagagatctgtgaccttgcaccctgagatctcaggctcaattaagagacaaaacaggcaatgcagtatcagtgcagatgggaaagagaaagcagaaagtatgaagagggaaaggaggagcacaaaggagttagcattagtctctactgagcaattcctattccaaccacgtcctaaatgatgagttggatcctagcagaaagggaacacatgttatttttaactgattttaacttgatttattgtaacctatcaggagctcttaataaatatggctctttatgttgtta

SEQ ID NO: 1884 - DNA, 1652 bp, Homo sapiens
gcgggcagcaggcaggacacgtggaaacgcaaccgccaggaggaaaggcgggacacagcgggaagggaggtttgcctcccctctcttcctgtggtgacccccacctcacttacaaaaatcaccaccgacgtttgggaaccgtgcacgccgactgaaagcaaagctcagctgacctgcgaggagtccccggggagctgccgcggtggtcgccgttgagtccgtccgtgccgctggggccgaggcagctggagatgtggtcaacgggctgatgggcacggctgtgggaccccatcattcccctgccccgcatgactctgctctcccagctcgactgctcacttcagacttcccttatggaaggagttgccagatagagcaagtaaaatacagtgtgccagacacaggtttatttcaacactgggaaggctccattcctacttaaacccagcagggaacagggagcggtgtgcagaggaggtggcctgcccgggaagccggccttggtgctgggactgcagggagagggctgtgaggaagagcacaggcttcatgcacattgcacagaggaggagattcatggggacagcaggcactggttaggcacagcgggaaggttatcgaagacaaaacacatttctacccaagtttaaatgacctgctatgcccacagagcttgatccagaagtgcacagtagagacggggtttcaccatgttagccaggatggtctcgatctcctgacctcgtgatctgcccgcctcagcctcccaaagtgctgggattacaggagtgagccaccgctcccggcccagaacttttaataaatataaatacacaggtaattttaacacatattcctgatgaaatcattattatctgcaatgctttcattctgctttttctcttaacaatggcataaacatttttcaaggtcaataaatgtttttcaaaatcgcatttgtattagtggctgtatagttttctatcaaatgtggaataaactcaatttatttctcccttttgttcttgaacatttaagatcattggttcatagttactaatcatgttacaacaaatattcatgtattccaaattttgctcattcctgattatttccttagatttccaggtatggaataattaggttgaagtgtttgaaatctttttttgttggtttgtttgtttttgagatgtagcttccctctgttgccccggctggagtgcactggcatgatctcagctcactcactgcaacctctgctgcctggttcaagcgattctcctgcctcagcctcctgaatagctggggttacaggtgcgcaccaccacgcccggctaatttttgtatttttagtagagacagggtttcatcatgttggccaggtgggtctcaaactcctgacctcaggtggtccttctgccttggcctcccaaagtgctgggattacaggcgtgagccactgcgcccggccgaagtgtttgaaatctttaagcatcctggtaaatattgagttttgtcaatatttagaaaagttgcatgattgacatcgcttccacccatgtttcagagcatctgatttgtcagaccctcaccaaaaatgggcttttatcaaaatgtaataaaaaataaatacaacttttccaatgacaaaa

SEQ ID NO: 1885 - DNA, 488 bp, Homo sapiens
gcccatggccgcagccctggcgctcgtggcgggggtcctgtcgggggcggtgctgcccctctggagcgcgcttccgcaatataaaaagaaaatcacagacaggtgcttccaccactctgagtgctacagtggctgctgcctcatggacttggactccggtggagccttctgtgcccccagggccagaataaccatgatctgcttgccccagtggttggaactcttcaagggcagggatcgcatcatattcatctatgaagcacctacccccagcttagtatctgcacataaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtc

SEQ ID NO: 1886 - DNA, 808 bp, Homo sapiens
gcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 1887 - DNA, 1301 bp, Homo sapiens
gcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 1888 - DNA, 1496 bp, Homo sapiens
cttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 1889 - DNA, 808 bp, Homo sapiens; identical to SEQ ID NO: 1886

SEQ ID NO: 1890 - DNA, 808 bp, Homo sapiens; identical to SEQ ID NO: 1886

SEQ ID NO: 1891 - DNA, 808 bp, Homo sapiens; identical to SEQ ID NO: 1886

SEQ ID NO: 1892 - DNA, 1301 bp, Homo sapiens; identical to SEQ ID NO: 1887

SEQ ID NO: 1893 - DNA, 1301 bp, Homo sapiens; identical to SEQ ID NO: 1887

SEQ ID NO: 1894 - DNA, 1496 bp, Homo sapiens; identical to SEQ ID NO: 1888

SEQ ID NO: 1895 - DNA, 1301 bp, Homo sapiens; identical to SEQ ID NO: 1887

SEQ ID NO: 1896 - DNA, 1301 bp, Homo sapiens; identical to SEQ ID NO: 1887

SEQ ID NO: 1897 - DNA, 1496 bp, Homo sapiens; identical to SEQ ID NO: 1888

SEQ ID NO: 1898 - DNA, 1496 bp, Homo sapiens; identical to SEQ ID NO: 1888

SEQ ID NO: 1899 - DNA, 1301 bp, Homo sapiens; identical to SEQ ID NO: 1887

SEQ ID NO: 1900 - DNA, 1496 bp, Homo sapiens
cttcccacctgtgccctgcagcgcgtggacaggctaggggtcgcggaagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 1901 - DNA, 1496 bp, Homo sapiens; identical to SEQ ID NO: 1888

SEQ ID NO: 1902 - DNA, 808 bp, Homo sapiens; identical to SEQ ID NO: 1886

SEQ ID NO: 1903 - DNA, 808 bp, Homo sapiens; identical to SEQ ID NO: 1886

SEQ ID NO: 1904 - DNA, 1978 bp, Homo sapiens
cttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaagg

SEQ ID NO: 1905 - DNA, 1978 bp, Homo sapiens; identical to SEQ ID NO: 1904

SEQ ID NO: 1906 - DNA, 1978 bp, Homo sapiens; identical to SEQ ID NO: 1904

SEQ ID NO: 1907 - DNA, 1978 bp, Homo sapiens; identical to SEQ ID NO: 1904

SEQ ID NO: 1908 - DNA, 1978 bp, Homo sapiens
cttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcggaagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaagg

SEQ ID NO: 1909 - DNA, 1978 bp, Homo sapiens; identical to SEQ ID NO: 1904

SEQ ID NO: 1910 - DNA, 1696 bp, Homo sapiens
cagtgggggcgcagtgcgagggtgtcctttgcgcctcagctccggagaaaaacgaaaggtgggtgggaaactaggatagaggtgaaaagtaagaggggactgaatcagcgaatgacaaagggagcagggctccggacaggggtaggaggaagaagaggagtgactggggcttgtgtcaagcttcttctgaatggctagacagccgccaggtgggagaggcggagggtgaagaggcgggttccgcacgcggttagcctggggctgatctagtcttcagctttcaccggctgggagtccggagctgcagcagaggccacacccagggcttggtggtcccgcgctttccggagctcagcaggcgcttgctgcttgaaccggtcaaagaaggaacgaatgaatgacccttttgccaggatggagacccgggggcctcagggagctgcgaatcccatggactcctcccgcagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattatcaggtaacacaagaagtgttgcagacctcctgggccaagggtcgcatgaccacgaggactgaggagcacttcgtgaccgcgctcacttttcgcagcagtagagagggacagcctggggaacgctggggccctgctgaatcccgggctctccaggcacgaacaggggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactgtaagcagcataatacctcctttgtggcttgaattccttcgctgtctggggacctaagtcattcagaagaggtggagaaaagatattttcagattggcagaatgtgggagttttgaaatgagaaaacctgttgttaatttgcattttggaataactctcaattgatctcttttctgttccccgcccccctcttgtttctctttaggacctagaaacagaagtgaagtttgaagtctgctctctgcaaagagggtgggagtgggtggagaagaggcttgttttaaaagccaaaaacagaaagtaaaaagaaatgggaaagtaaaaccaaagcagcaagtgactctcttctgatgtgcacttttcatttttctcccccacatttcagtgttagaaagaaaacgagaggagctagggaaagaa

SEQ ID NO: 1911 - DNA, 2265 bp, Homo sapiens
ggcccgcgaatacgcgtggaccttgtggaacgccgggcctccccgggcgcccccgctctctggtagttgccgggagacccggccggtggggaagcccgcggagccgcagccccggccccggaaggtctctctgggccccgggcccgactcccacccctgcgccggcccgcgggcttcgcaggccctgcactgccgaccgggctgcgctcaaggccgccagccgcccgccgccctctttgtccccccgctgcaggaaggccgcggcagagggggcgccctccaagccgtcagccacgcacgcggaggcgctcgggcctcggggcggcgcaccgggagagcacgccggggaggacacgtgggccttcgcgcggattttaaggaaacagagcaacagctacaacaaaatggggagaagaaatgagaactgtgctaacagcctacgtgtgtcaaacatctctcaggagaacttatctcactggaatttggattcagaagtacctgtttctgaaaataaaaacctcccagctggaagggatggagcagcaggtggcaaaattaacaagaactatttggaaattccagtggagcaactgatgctagaacctaatttgtcggtgcatagtcaaaaaagtacacagaatagtaaacaagggatctttcaattatggaattgtcctcttaatgaaggaagtaccatagagaagagggaattcaaaaaatcttcagtggaaactggctttaatgtaatcaatcatcctataagggtcttcactctgaaccacccattaacaattgcttcagttgataagcaagttggtccttaccctggactgccaatgccattaggtctctgctggccctatgctgatggagacttttttaagaacagaaatgagattcatgttagttcatgttcaactatagaaaacaatgatggtgaaacattacctgctccaaattggaatttgaaacatggaaacagcagtgtggaagaaaatttcacagatgaaagtgatttatcagaaaatgagaagacaaatgatactttactcagctattttaaaaaggtggacctgaacttgaagccagaaacaataaaaaatgttgaggaacctttcaccgaggagccaaatgaagtatttccatatcctgattttctccctcctcctttcagtgctctagacttgcacaatttagccctctccaaatctgacaattggaaagtgacagtggaccctgcagaaacctctgttgaacacttgataactcgtttactggaactagaacgattacaacatatgactattcaaaaagagaggccaagactacaaacgactttctgtactccagcagttactgaacgaccctcttcctccaaagctacaccaaaagtgagacagccaaaactttgcgactctttgagtcttcagataccttgtgtagataaaagtcaagaaaaaagtaaaaacaactctggttcttgtaagcttgaacaaaatgctttaaaacggaattggagcaatgctggcaaatatagatggaattctagaccactgtctctaaaaagttcttccaccccaaaacaattgattgaaacttatgataagaatcccaaaagttctattttaagtccatgccaagaactctcattcaaacctactattggccatacaaatcaatcaatggttaaaatggtctccacaagatgtctgccatggaggtctccaatgccagtttcacctatacctctgacttttcccgaaaatcagaaggaagaaattaaggcaccgaagagaaactttgggaccaaaaagaaactttaccgacaaaatatagtgttgaatagaccattctctattcagaagctaaactgtttgtcgccttcccttattgctaaggataagtgctgctcacccattgaacaaaaataactcttttctttcatacatctcaatgtgaacacatctactctaagaagcccaactaagatatggttaattattccaagacacaggtactattaacagtcccccaaaatcaccaaacagttgcttgatgtgatatggagtagaacttgtgaaaagcactgctgagatgtctatatataaacccacaggcttctatactgacatatttcacaatcttttgcatgttgtgtttcaagtaaatggttcacttggtagactattctattcaaaaggctactcttttttcagtgattgttttccagtataattccatcaataaatggtataattgacttat

SEQ ID NO: 1912 - DNA, 1068 bp, Homo sapiens
atgctgatggagttttttaagaacagaaatgagattcatgttagttcatgttcaactatagaaaacaatgatggtgaaacattacctgctccaaattggaatttgaaacatggaaacagcagtgtggaagaaaatttcacagatgaaagtgatttatcagaaaatgagaagacaaatgatactttactcagctattttaaaaaggtggacctgaacttgaagccagaaacaataaaaaatgttgaggaacctttcaccgaggagccaaatgaagtatttccatatcctgattttctccctcctcctttcagtgctctagacttgcacaatttagccctctccaaatctgacaattggaaagtgacagtggaccctgcagaaacctctgttgaacacttgataactcgtttactggaactagaacgattacaacatatgactattcaaaaagagaggccaagactacaaacgactttctgtactccagcagttactgaacgaccctcttcctccaaagctacaccaaaagtgagacagccaaaactttgcgactctttgagtcttcagataccttgtgtagataaaagtcaagaaaaaagtaaaaacaactctggttcttgtaagcttgaacaaaatgctttaaaacggaattggagcaatgctggcaaatatagatggaattctagaccactgtctctaaaaagttcttccaccccaaaacaattgattgaaacttatgataagaatcccaaaagttctattttaagtccatgccaagaactctcattcaaacctactattggccatacaaatcaatcaatggttaaaatggtctccacaagatgtctgccatggaggtctccaatgccagtttcacctatacctctgacttttcccgaaaatcagaaggaagaaattaaggcaccgaagagaaactttgggaccaaaaagaaactttaccgacaaaatatagtgttgaatagaccattctctattcagaagctaaactgtttgtcgccttcccttattgctaaggataagtgctgctcacccattgaacaaaaataa

SEQ ID NO: 1913 - DNA, 1140 bp, Homo sapiens
caggatgcagggccgcgtggcagggagctgcgctcctctgggcctgctcctggtctgtcttcatctcccaggcctctttgcccggagcatcggtgttgtggaggagaaagtttcccaaaacttcgggaccgacttgcctcagctcggacaaccttcctccactggcccctctaactctgaacatccgcagcccgctctggaccctaggtctaatgacttggcaagggttcctctgaagctcagcgtgcctccatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacccgaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagttctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgttaacatgtttccagcactatccccacttttcagtgcctcccctgctcatctccaataaaataaaagcacttatggaa

SEQ ID NO: 1914 - DNA, 1140 bp, Homo sapiens
caggatgcagggccgcgtggcagggagctgcgctcctctgggcctgctcctggtctgtcttcatctcccaggcctctttgcccggagcatcggtgttgtggaggagaaagtttcccaaaacttcgggaccaacttgcctcagctcggacaaccttcctccactggcccctctaactctgaacatccgcagcccgctctggaccctaggtctaatgacttggcaagggttcctctgaagctcagcgtgcctccatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacctgaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagttctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgttaacatgtttccagcactatccccacttttcagtgcctcccctgctcatctccaataaaataaaagcacttatggaa

SEQ ID NO: 1915 - DNA, 1291 bp, Homo sapiens
accttctatggcaggggcttttagcaccattctttaacgttagacacataaccacagcctaatcacttgaaccatttaatccttaccagcctctagcattatcctaaaaccctgaacctcttccagctttcttaaactttcagcttttcttgaaacgactttttctgattctaagattattttaactgtaagtaggagaagacatctgaaatttaactatgatcagaaattcagattacaaaaactttgtttgctgtgctgtttgtaataaaataattccaccagccccttttggaaaaaccttcaaacggatccatgaatacaagccacttaagacacgcttttacactcacaaagacatactagatattggggcaaatattctgaaaaaagaagagcagtttcaagaagatatactcagagaacacattgcgaaagcagaagctgaagtatgggctcaggtaaaagaagttacatgctaatgaacgtcaaaaacaagcagtggagaaagcacttgaagaagcaaatgacagacacaaaattgaaattcagattttgaaagaggaacatcagaaagatttacaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactcaaaaacca

SEQ ID NO: 1916 - DNA, 1296 bp, Homo sapiens
acttaaatcttcccaaatctggtgcccataccttctatggcaggggcttttagcaccattctttaacgttagacacataaccacagcctaatcacttgaaccatttaatccttaccagcctctagcattatcctaaaaccctgaacctcttccagctttcttaaactttcagcttttcttgaaacgactttttctgattctaagattattttaactgtaagtaggagaagacatctgaaatttaactatgatcagaaattcagattacaaaaactttgtttgctgtgctgtttgtaataaaataattccaccagccccttttggaaaaaccttcaaacggatccatgaatacaagccacttaagacacgcttttacactcacaaagacatactagatattggggcaaatattctgaaaaaagaagagcagtttcaagaagatatactcagagaacacattgcgaaagcagaagctgaagtatgggctcaggctaatgaacgtcaaaaacaagcagtggagaaagcacttgaagaagcaaatgacagacacaaaattgaaattcagattttgaaagaggaacatcagaaagatttacaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactc

SEQ ID NO: 1917 - DNA, 1560 bp, Homo sapiens
agtaaagggaaacagacatgaacactaggtgacatggagtgttaggggcgctatggtagaagtctgcagagagtgcaatgggcgtccaaatgaggaagtgatcacttgcacaagagtgggaggcttggctggaaaggcttctctgaataggatgacatttgatctgtgttttgaagggcatcgttggcaaggtaagtaatccaattaaaggaggttgcctcagctaaagcacagtatgctcaaaggtgcggatcatttgaaaatttgagttcaggtgcagtaggggtaaggtaagtatccaacagaattttctacaatgatggaaatgttctatattgtcactgtccaatacggtagcctctagccacatttggccagtacaactgaagaattgaatattaactttcatttaattctagctaatttaaatttaaatagtttcatcagttagtggctaccatattgaacagtgcaggtttagagataaacagaggccagttgcaggagggtcttgcatcccattgaggaggactgaattttcttctgcagggccttctgtggtctgcagaaagggcagtacacaggcagtaatattatcagctttgcctgtgggagtgccccagcctggaagcagataatacagttaggagattcccataacctgcctgagtgagagcattagtaattagggaaggaaatggatgtgagacttgctgagaagggctggacaggcttagtgacaggtctgagtgtgaggggagagggagtgggggaagtgggatcaggtttgagccagctattaaatcaatgccaattcatcccataaagaatgcagagagtgggacaggtttggagagtgtaaggaacatggctgtgctgtagccaagcaggcatagggtagcaggaataggccgaggtaaacagcctagacatctcagcgggattggggtgcaagtgcacagtcctgtgtcttatatagtcacagccatgtaggcataacatagagcagctccccacctggctctcagccactagtgtttgtgtagtgtataaatgtaacactgaccctgtgaaggggctgctgaataaagccatgtctcatttacctgctgtctctccagtgttcttccagctccctgccccacatccacccactgtcctcagacctcagctggggctgcaccccaaccctgagtgtgacagagagaagatgagtgttagagatcatgatcctgaagtgctgacgagaaattcagcctgcaagcctagaggtcagctcagtggccaccttctgaagcccagggcaccattggaagctgcctagtttgaggcacggatggaagaggaaaacactgagaacaacatccctcttcctgaggaatgcatacaagggtgcttgggggtgggttggggatcccaaggcaggagagccaaagctggagtcagaggaagctcttcttctgaaacctgtaatttcaatgtcttttcctttcccttcaaaattgtaatttccttctgaaatcattctaaccctttagtaaagacattaatttaaagatg

SEQ ID NO: 1918 - DNA, 1395 bp, Homo sapiens
gcatcgttggcaaggtaagtaatccaattaaaggaggttgcctcagctaaagcacagtatgctcaaaggtgcggatcatttgaaaatttgagttcaggtgcagtaggggtaaggtaagtatccaacagaattttctacaatgatggaaatgttctatattgtcactgtccaatacggtagcctctagccacatttggccagtacaactgaagaattgaatattaactttcatttaattctagctaatttaaatttaaatagtttcatcagttagtggctaccatattgaacagtgcaggtttagagataaacagaggccagttgcaggagggtcttgcatcccattgaggaggactgaattttcttctgcagggccttctgtggtctgcagaaagggcagtacacaggcagtaatattatcagctttgcctgtgggagtgccccagcctggaagcagataatacagttaggagattcccataacctgcctgagtgagagcattagtaattagggaaggaaatggatgtgagacttgctgagaagggctggacaggcttagtgacaggtctgagtgtgaggggagagggagtgggggaagtgggatcaggtttgagccagctattaaatcaatgccaattcatcccataaagaatgcagagagtgggacaggtttggagagtgtaaggaacatggctgtgctgtagccaagcaggcatagggtagcaggaataggccgaggtaaacagcctagacatctcagcgggattggggtgcaagtgcacagtcctgtgtcttatatagtcacagccatgtaggcataacatagagcagctccccacctggctctcagccactagtgtttgtgtagtgtataaatgtaacactgaccctgtgaaggggctgctgaataaagccatgtctcatttacctgctgtctctccagtgttcttccagctccctgccccacatccacccactgtcctcagacctcagctggggctgcaccccaaccctgagtgtgacagagagaagatgagtgttagagatcatgatcctgaagtgctgacgagaaattcaggaagcctgcaagcctagaggtcagctcagtggccaccttctgaagcccagggcaccattggaagctgcctagtttgaggcacggatggaagaggaaaacactgagaacaacatccctcttcctgaggaatgcatacaagggtgcttgggggtgggttggggatcccaaggcaggagagccaaagctggagtcagaggaagctcttcttctgaaacctgtaatttcaatgtcttttcctttcccttcaaaattgtaatttccttctgaaatcattctaaccctttagtaaagacattaatttaaagatgtttaaaaa

SEQ ID NO: 1919 - DNA, 2196 bp, Homo sapiens
atggttacgcggcggtggctgcgagcgcccaactgctccgaccgtcgcggtgagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccactcatgagggctgaacttcagccatatatgttaaaagaagcgctatataatatacgacaatatgaggtcttccttcagatcattttgtcagatataattactggtgctcaagaagtggaaatgatgacaaaacagttaggagcccatctggaacaactaaaaatgaccataaaatcaaagatagcggtcccaacatcacaagtctttcctatcttcattgcactttctactctgtggaccagcttgcaagacgaaactattgtggttggtgtcctcagtaatttattcactcacattcagccattcttgggtgctcacgaactatactttcctgagagagtgatgcaatgtcatcttaatggagcgactgtgaaaactgatgtgtgtagaatgaaagaacacatggaagatagagtaaatgtggcagatttcagaaaactagaatggcttttcccagaaacaacagcaaattttgataaactgttaattcaatatcggggattttgtgcttacacgtttgctgcaacagatggtcttctccttccaggaaatccagcaattggaattttaaaatataaagaaaaatattacacattcaatagtaaagatgctgcatattcatttgcagaaaatcctgaacattatattgacatagttagagaaaaggccaaaaaaaatacagagttaattcaactattggaacttcatcaacagtttgaaacatttattccatattctcagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaaggtatattaacatctatacaaattaattttgtaggggtggcacattcattggttgtgtgactgtttattgggttcccatattttatcaaactgttttctgtaacacatttttcattctgttgaaattgaaaaataaaactgtccatttatctttta

SEQ ID NO: 1920 - DNA, 1050 bp, Homo sapiens
ggagcgcgcacacagatccggagcgcgcacacagatccggagcgcgcacacagatccggagcgcgcacacagatccggagcgcgcacacagatccggagcgcgcacacagatccggagcgcgacggactctcccactgactggcacttgcgcatgcgctgcctgtgatcttggagtactgattataagctgttttaagcgattcccttaagccgcgcactgttgtaaccactaaaaacaggactaatttagtcctcacacctctggaaagaagtgaagcaagtgcccaagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccact

SEQ ID NO: 1921 - DNA, 2017 bp, Homo sapiens
cacaaagagcggggcggagaggcagctgcggggggagccggcggccgctgctgccgcccagggctctggggccccgccggccaggcccgccgtccgcggccagtgcccttcctcctcctcctcctctgccgccgcctcctcagtcgccgccgcctcctcagtcgccgccgcccgcgccgcccgcgccctccgcgcgcctctgagcccgcgccgggccgcgccggccccttcccatgcgggcggcgcgggccctgggaggggcgcccggagccagccgcgcagcatgcactggggggttggctttgcttcgtccaggccgtgcgtggtggatctgagctggaaccagagcatctccttcttcggctggtgggccgggtccgaggagcccttctccttttatggggacatcatcgctttccctttgcaggattacggtgggatcatggcagggctgggctccgatccctggtggaagaaaaccctttacttgaccgggggagctttgctggccgcagctgcgtatctgctccacgaactcctggtcattaggaaacagcaagagattgactctaaagatgctattattttgcatcagtttgcaagacctaacaatggtgttccaagtttatctcctttctgtttaaagatggaaacttatttaaggatggctgacttaccgtatcagaactattttggtggaaaactctctgctcaagggaaaatgccttggattgaatataatcatgaaaaagtttctggcacagaattcataattgactttctggaagagaagcttggagtgaatttaaacaaaaaccttggccctcatgaaagagccatctccagagcggtgaccaagatggtggaggagcacttctactggacattagcttattgccagtgggtggacaatctcaatgagacccggaagatgctctctcttagtggtggtggtcccttcagcaacctgctgaggtgggttgtgtgccacataacgaaaggaattgtgaaacgcgagatgcacggccacggcattggccgcttctccgaggaagagatttacatgctgatggagaaggacatgcggtctttagcagggcttttgggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaa

SEQ ID NO: 1922 - DNA, 941 bp, Homo sapiens
ggaaacttatttaaggatggctgacttaccgtatcaggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatatt

SEQ ID NO: 1923 - DNA, 2434 bp, Homo sapiens
gagcggatgccaccccgtttccagcctccggtgctcaccgtaatgctcacaacaacctagcaaagtggggatcatcttcaccactgtacagatgaagaaattgaaggtcagacattcaaggttatgtggccacatgagagaaataccagagctgggatgaagactcaacggctctcagacaccaggttgcttcttgagagaagccggatggatgtgcatgcagggagggaagttgcctctgaggaacggcctacagtggcttacaactcccgggagggatgtggaatctatccccccaacagcccatgaagacttataaaagctgacagatgcaaggttttcagccatgcctttgataagatactataaaagtaaagtagcttctgccctaaaagctgagcgctatttccagaaaatcaacaatggaaatgataggcatttcttttgaaactggcacattcataatggacatagaagaatcaacataagaaagtagcaggtattggtctttcctgtggtccctgatgatctatccacttgacctcttcaggaacattccctggaagcaggggaagtgctttgcttccctgtctcccgagggagaaagggcatttgatggcatggagccactctgccagccaggagccaggcccgctctaagggggctacagcatgcctcagattgctacaggctcctctcccctcccgggtccggccttgtcggcaccaacccctcagttcctgccccatctccccactgcggttgctgtcaggcctggagcatttcctccttcactttcacgggtcccacacccttcaagatcaacagtgaccaggccactccctgccatctgagaagcccagaaaccatcttccgtcagagggagattagcaatgaagctttctgacgtctctccctgtaccaggctcaaaaggaatttcatcctttctttccattcactgcaatgagctctcacactcatttgaaatgtgcggcctgatgacccacacacctctcaggggagccatggccccacggctgtctccccctgaagatgtcgtccctgtctgagcccctcctcattacaggagagaacgagcacctgccagcaccggcagcccctcgatcctaacctcagatggcaccctttgggtgcggagtgggaaaggaagaagactcagctggtgaaggctcagtacttttccttttccgcaatcactaagtaattttctcatccttgaaagcaattttctgctgaaattcagaaagaacttattttgaagttacgccagtaaaagctctggaaactgtgatgggagcttgtgctggaagccgaggacagagctccatgctgattctccattcctcttatttatttgcatgatctgagctaatttctcagctgtaatctacaccacccaccacctagaaacttcccagaaacgtccagcaggggaggggtgggaacgagaaagaaagcacccaacgctctggcagggtctgcgcagccgccagactctgtttctagacggtcacggccgacttagtaattcacttagaagatctcctgaaataagcacaaaatgttggcagcaaatggtcaaagggaaatgccccagttttcttaggggacggaccctgttactttatcagatagcagtgtgagctgaagtgtgaagacagggcagacactaatggtattttgttcatcctgaatttttttttttggcattaattttgatctttaaaaaatattgcattaggaaatgtaaatgcatatgagtaagtgaaagaaaccaatctggaaagtctacacaccgtacgattccagctatatgacattctggaaaaggcaagaatagagaggcagtaaaaagatcagcaaagagtaaaaaataagtcggaaagggacaaataaggttcttagggtgtggagactacatctgtgtgatagtacgatgggtgggtacatggcattatgcatttgtccaaacccaccgaacggacaacaccaagagggaaccctgctataaactgtggcctctgtgcgatcatgatgtgtcaatatgggttcatcagctgtgacaaatgaaccccacaggttggggatgttgacatgggggaggctgtgcatatgttggggaaggtgatatgtgggaactctctataccttctgcccaatattattgcgaacctaaaactgctctcaaaaatatagcctaagaaaaagtaactttaatcttgggagttattgtttactgggtacagagtttcagttctggaaggtgaaaagagttctggaggtagatggaggtgatatttgtacaacaatgtgaatacttagtgccattgaaccgtacacttaaaaatagttcagacggctaactttatgttgtgtatgttttactgcaattaaaaaatgttacttatctt

SEQ ID NO: 1924 - DNA, 1272 bp, Homo sapiens
cgcgtattcgcgggccgcggggtcgccgccggccgcccaggcgcggagcctctcgggggtcacccggccgccgggcccgcgggacgcacggggccgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacaccaaatccacatagttctgcctggcagcttcctgaacggacgatgacaaacaacctcagcccatggtcaatgaataagcactttgagaaagttactatactaataactaacaccttgcaatgaagaaagaatagaagcacatcaagatcttgaagactccatttacaatggcttaatgagaagcacaaacttctttagaagtacagcaaataaaagcacagtaactagtaaactc

SEQ ID NO: 1925 - DNA, 1013 bp, Homo sapiens
atcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacagaataacatgaaagctgtatacctattgtggaatttgattagaatccggaacagtcagagttggaacaatgttcacaacaaaatgcaagttaataatgaaggaaaaataaaatcagtcaaatcagcctaatgctttgggaaaaatctaaattcagttaattctaccacaaacaacatgtaacctgcttatgactggcaacgctgaaggaggattcaaaggctctcatctcgcgctgcttgcctgacctcttgctttctaggagctgacttaccctgtcagatgcatacacggcatcgaatagcccaaggagggtgacggagatgcccacagctggaccattgaccactgcaatcagaggcttaggaaaatctataaaacagcccacaaattccctacagaaatggaaacacaaaatcattaaatgtgcc

SEQ ID NO: 1926 - DNA, 1873 bp, Homo sapiens
cgcgtattcgcgggccgcggggtcgccgccggccgcccaggcgcggagcctctcgggggtcacccggccgccgggcccgcgggacgcacggggccgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggatgaacacgcagggttccggaccaatacctgggccattgtgactctcagaatgccaggcaataagagatcagaaagctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagatggctgaaaaagaacatgcaacccactgaagacctcaagtcagtgatctgtaggctgtcagcatttggcccaattcagtcagccactgtttgtggacgtcaaagtgctatagtggcattcaaagacatgacttcagcctgtaatgctgtgagtgcttttcaaagtaggaccccaggcaccatgttccagtgttcctggcaacaacgattcatgtcaaaagacaaaacttattcaaaaaaatgtacccagaagacacagcctaaggaatacaagcaggaaactgagaaacctgccaacaacagctaaagggacacaaacaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacaccaaatccacatagttctgcctggcagcttcctgaacggacgatgacaaacaacctcagcccatggtcaatgaataagcactttgagaaagttactatactaataactaacaccttgcaatgaagaaagaatagaagcacatcaagatcttgaagactccatttacaatggcttaatgagaagcacaaacttctttagaagtacagcaaataaaagcacagtaactagtaaactc

SEQ ID NO: 1927 - DNA, 1834 bp, Homo sapiens
gtattcgcgggccgcggggtcgccgccggccgcccaggcgcggagcctctcgggggtcacccggccgccgggcccgcgggacgcacggggccgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggatgaacacgcagggttccggaccaatacctgggccattgtgactctcagaatgccaggcaataagagatcagaaagctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacaccaaatccacatagttctgcctggcagcttcctgaacggacgatgacaaacaacctcagcccatggtcaatgaataagcactttgagaaagttactatactaataactaacaccttgcaatgaagaaagaatagaagcacatcaagatcttgaagactccatttacaatggcttaatgagaagcacaaacttctttagaagtacagcaaataaaagcacagtaactagtaaactcaccttgggcaggctgccaagggcattccatgcgtcccatttggccttgttgatcaagtcaaatacacctggtttgggcatgttacaaggtccttcagtggcctgtgaaaaggagaggggcaatatgttcaaatgtccatgtaaactagacccctaaatatttaagatccataaaatctgtaagtaca

SEQ ID NO: 1928 - DNA, 2576 bp, Homo sapiens
gcttccggctttcgctcgcttccatatccgctcctctagtcgccctccgctggccccgccttcgtccccggaagattgggtcttctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtgggatcatttgcatatcttacaattaaagacagaataccacagatcttaactaaggttattgatacattgcatcgacataaaagtgaattttttgagaaacacggagaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactgaaaa

SEQ ID NO: 1929 - DNA, 1439 bp, Homo sapiens
tccttcgcggcggtaccgcctctgtttctgcggcgattgaacagccgagctttgcggccgggatcgcggaaagtgatggctgtcgtcccggcgtctctctcaggacaggacgtggggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactg

SEQ ID NO: 1930 - DNA, 3736 bp, Homo sapiens
actcagaaaattgccagcaccaaagtagtggcatcttctccctgggagagctgggtctgacttctcactggacacaacttccagctgacagggagcagagcctaacacagagacctcttgtctgaagatcccagcccagggtgttcaggacagaagcgatttctgtggtccaagcccgatggagaatccaaggtgcccaaggaggcccctggcggagaagaaagccaggtctctggacaggccgcaggcccccgggaaaggctcggagtcgtgggactgccattggctctccctgcccactgccccctccaggaaggcgcttcactggacgaccagtgattgggccagacattcagacagcccagctccatctgcagaggctcactgcaccaccgctgcagcccccactcccgaggagaccggagattttctccccagcgagcagaggccttcgcaagacaccaagaaggggtggctgaagaccatgctgaacttcttcgtgaggacgggccctgaggagcccagagaaaaggccagcaggaggccaagggggaaggagggtatctcccagcatccggagcccctggaagcagcaggggagccagccctcaggaagaaagcccaccacgacaagaagcccagccgcaagaagcaaggtcacaagaaacacgcggccgaggtgactaaggcagctcaagaccaggaggccagaggccgagaggaagggttgtccaaggcagctgctgccttgcgctccggggaggctgacctgggcccagctcgcaggggtggggaagattctgatcaccagtccttcctcatcaaagtggatggtactggagctttggatgtttctccccatgccacaggtcatcagcaagaagaggagctcaaaaagcctgaccaggatgctatcattcagatgatagtggaattgctcaaaagagtgggagaccagtgggaagaagagcaatctctggcctcacagctgggggtggccctgccaaacccagcaccagctgttaggaagaaatcccaagagaaaaagacaagcctcaagagaacctcaaagacaaaccccaagaaacacggctccgaggaggccaagaggggggctgcagatgtttccagtccagaggcctggccacccaagaagtccagctttctgcccctgtgtgtcagcggccatcggccttccatctccagcagctatggcttggaagaacctaaagtccaggaggccccatctacagaggctggggctccaggtccctccgtgcttcccaccccatcagagagccaggaacctggagaggagcttccgctggacagagcctcggaatacaaagaattcattcagaagatcatttccatgctccaagatgcagaagaacagcaaggagaggagcaacctcaagtccagcaggaagaggtgggtgtagaaaacccggccccacactgcagaaggaaatctcaagaaaaaaggtcgagcttcaggagagcgttttaccataagaaacacacctccaaggaacccagaagagcgggggcagcaggggctgccagcccagaggcccgacgacccaagaggcccagctttctgcccctgtgtgttggtggccatcggccctccacctccagcagccttgatccagaagatctcgagtgccgggagcccctgcccgcagaaggggagccagttgtgatctcagaagcaccctcccaggctagaggccacacgccagaaggggcacctcagctgagtggagcatgtgaatctaaggagatcatcatccagaagcttgtggcacttctccaagaagtggatggccaactggggcagcagatcaggcgccaccccagctttaagaggtttttttacgagttctcggactcctccctcagcaagctggtagccaccctgcgcagccaggtggctcactcctctaagctggacaggaaccgcgccaggagactctaccagtttgacgttagcttagctaacaaatttgctggcagcaacagccatgccatgtgcatcctcatgggcctaagagaccactacaattgcacccagttcccatacagggaggaccagccgaacatcacaagtcctaaggttgaaagtccagattgaaagctgtgtcttgcactcaaattcccttgaactagccaaatggttcgcagctttagccaggagaccctgaagatgctctgtgatgtcccaatccctgcttcacaaacgtgatggaagacaagagcagacaatcattctgtgtccataccctagtatctgagaagcacagagcattcttccacaaggcaagacacagaggccatgtctggggaaatcagcactggactgggaatgaggaagactggggctctacctgctgaacctaccccagacttgctgcatgaccctctacacattccccctcctctccagactttggagtctaggatcccacccagaaggcctactgatattttctcagatgttcatgttaactgagtctagtttttaaactaaatttttatttaatctctaaacagaacatccacatgcatccaaacagatatgcatcgaagtgtatcccatcatttcttcagttgaccagtagttcttcatgctcatatggatttgtagatgcctcccaggaactctgcaggcccaagatggaaaaacctagagactggggacacttggtctctcagaatccttctaaccctgtgtcctgtcattctatgactagagaaatggagctgataccttgcacctctcccatctcatgggattggctaggagtcagtgagaaaatggatgtgaagagttctgaaaattacctagtgccatgtccatgtaggcactatagcttcttttgggtagttttcaggaagtggaggagggcttcaatgggctggactgccatggattgttgcacaggggtgcactgctcaagagcaccatactccaggaggtactattcatgtcctagacattgtggatttgtagatttatcatgacagttttgcagctggtagcagtaacatgtcttgagaaaagggctattttttgtatttgcacaaaggtgaagtgtgggggtgccagaggctctgccttctgtatagctcaacagtttcaatagcttgactcaggtgtgaaatttgccacatgttcatatctatgtgcaggaaggacaagactgtagacagacagtcggctcccttggacactgcccagaacatgtggtcatgggggaaagggtgttaaacctggatggcaagtgagatcttgtgacccttggggacatggtattgccgtgttgaacctgctgtcgcaccatggggtaggactggggaggaggagcagtctagagcggagaggccctgggtgcttatatgggactggcctccaacctgaggcactggcttcataagctcaactcagcctatccggaaagccatttagtttttattgctgcttctgagaagtgggggagaggtgagctatttgtggatttgttttaggcagtgttcacaatcatagcacctaaatatgaaggatcagaataagttatgaaatgaaggtcaggaaccttttgtacatagtttcttatttggaatgatgttctttaagccctatgagtatttggtatgtgctcctgatgctggcatctgagtctcatttttgtaccgtgttatttgagcaaataaatacattaacttgcacaaa

SEQ ID NO: 1931 - DNA, 2763 bp, Homo sapiens
ggcggctgaggagtggggtgatgatgccactggcagaagcaggcgccctggcccaaggaggaggcccttcagcaacggagtgggcctgcattctgcggaggaagacccccaggcacaagcagcccaccttactgatggtcagagcatccagaagaagtggcaagacttcagctgtcctcaaagcaggaagacagagtgtttctggcagaaagaacagcacaagcaaagatctggtaaccctaggtgcctccagtttgagggaggagagaggacaccccctccaccccagacataggaaagcagtccacctgcgcaccaggggcaggacacgtggctgggtgcagacgctggcccggatgtcgcggaggactcgcgggccggtagagcgcgcggcggcggcggcggcggcggcggcgggaggagacgcaggtcacgcccccttcccaccacctcccgccgccgacggggcgcgcgcgccgaggagcccgggacaggtgactcctagaggactgcgtctgcgcctcccccggcgggagtcccttcttcgcggcctctgccgccccctgcgtcccctcctgggcttccgagagtctgactcagccaagccggcatcgcttcgcctcctacaacacaccccgagcgcgagaagaaattacaggattgcaggggcacggctaatgcgctctaattacccaccgccgctgtcatccgcggcgctccgcggcgctgggccaacgcgccgtaattaagacgccgctccccggtcccggaaccctcccttcgccaccctccacccacccacctcgcggtccccaggaccactggctgccaactcctgccgccctctgggactgcccctcagtcccaggagagctatgaggcctcactgggggcagaacttggggagaccgaagccggcccttccactcccctaaacctacagtcctggaaggtctctgctggaagagactgggagagtggggaggggccagggacctatttcgttgacagaaacagtgaggtctattggaaagttagccttcagtgggaggagtggcaaaggcacgcagggcagcagtacccccgtttggcacttgaggcacggagaagggaagggaagtccgcccagccagaactcccagacccgctcgtttaacagtggctttatgagcagcacgacggactccctcccctggcggggaaattaccttcctgcgaagaaaggtgacatccccgccacagacacggaggccccgcctgctggccagctgtggccgccataggggagctggtgaggagtgaggtggctctggcctcccatgtcaggtagggtgagagaggccctgaagatagaagccaggcccgaaggccagaattaaaggggtagcttggccatcagctccttcccccaaaaccaggctcagagctctcctctatcagcaattctttcctgaggtccagggtgttgcaaactcatggccttgggccacgttttaccttcagtgaggttttgtttggcttgcaatgagtacatgggttttaggttgaatgtgagagtctgcagacaatgtgggttctccgactgccctcccagtgaaggtggacctctgatttagaccggcccgctgggcccgtgcctacatccttttcctcagcgtcaggatcttagtccccatgattgctgcccctttgtggtctgcatgtttcttggtaagggtgcccagtcaagtgtctctgggagccccctcttctctgtcatcgtcaggctccccacttgcagtggccgtggtggctgcacatgctcccggatacccctccagcactcccttttgtcatcttgagtttcagtccgtgacttgggtggcaccctatcttctccatcagggatggtagctatttttctgccatgagactagaggttgcttgagaacaggaaattggatctctcccttcaggctgggatttcactaagggctggagaaggggggaatatgggaggattatctcctatcacagggagcgctctgagggcaaggctgtgtctccgattcagactgacggttccctgaggatggggctgtttctcccctccgactggggctccctgaggatggggctgtttctcccctccgactggggctccctgaggacagggctgtgtctcccctcagcctggggctccctgagtcagggctgtgtctcccctcagactggggctccctgaggacggggctgtgtctgcctcagactgggaatccctgaagatggggccgtgtctccctcaaagtggggctccctcaggacagcgttgtgtctcccctcagactgcggctccctgaggacggggctgtgtctccctcagactggggctccctgaagaaagggctgcttctccctcagactggagctccctgaagatggggctgtgtccccctcagactggggctgcctgaggatgaggctgcatctcccctcagactggagctccctgagggcagggctgtctccccccttcagactggggcctcccccaaaggacagggactgtgtctcccctgggactaggttctttgtgtcttctgcatcagacagattcccatgaggacagggctgtctccccctccatctggagctccctgaaggcaatggcctctcccctcaaatgggacatttgcaccccaccccaccctctggctccccatggcgcccaggcattcctcccaggacaccatttgtcacgctttgatgaatgaaacttactaa

SEQ ID NO: 1932 - DNA, 2757 bp, Homo sapiens
gtgatgatgccactggcagaagcaggcgccctggcccaaggaggaggcccttcagcaacggagtgggcctgcattctgcggaggttgttgaggaaggagggagtagatggagggctcttttcaccagaagacccccaggcacaagcagcccaccttactgatggtcagagcatccagaagaagtggcaagacttcagctgtcctcaaagcaggaagacagagtgtttctggcagaaagaacagcacaagcaaagatctggtaaccctaggtgcctccagtttgagggaggagagaggacaccccctccaccccagacataggaaagcagtccacctgcgcaccaggggcaggacacgtggctgggtgcagacgctggcccggatgtcgcggaggactcgcgggccggtagagcgcgcggcggcggcggcggcggcggcggcgggaggagacgcaggtcacgcccccttcccaccacctcccgccgccgacggggcgcgcgcgccgaggagcccgggacaggtgactcctagaggactgcgtctgcgcctcccccggcgggagtcccttcttcgcggcctctgccgccccctgcgtcccctcctgggcttccgagagtctgactcagccaagccggcatcgcttcgcctcctacaacacaccccgagcgcgagaagaaattacaggattgcaggggcacggctaatgcgctctaattacccaccgccgctgtcatccgcggcgctccgcggcgctgggccaacgcgccgtaattaagacgccgctccccggtcccggaaccctcccttcgccaccctccacccacccacctcgcggtccccaggaccactggctgccaactcctgccgccctctgggactgcccctcagtcccaggagagctatgaggcctcactgggggcagaacttggggagaccgaagccggcccttccactcccctaaacctacagtcctggaaggtctctgctggaagagactgggagagtggggaggggccagggacctatttcgttgacagaaacagtgaggtctattggaaagttagccttcagtgggaggagtggcaaaggcacgcagggcagcagtacccccgtttggcacttgaggcacggagaagggaagggaagtccgcccagccagaactcccagacccgctcgtttaacagtggctttatgagcagcacgacggactccctcccctggcggggaaattaccttcctgcgaagaaaggtgacatccccgccacagacacggaggccccgcctgctggccagctgtggccgccataggggagctggtgaggagtgaggtggctctggcctcccatgtcaggtagggtgagagaggccctgaagatagaagccaggcccgaaggccagaattaaaggggtagcttggccatcagctccttcccccaaaaccaggctcagagctctcctctatcagcaattctttcctgaggtccagggtgttgcaaactcatggccttgggccacgttttaccttcagtgaggttttgtttggcttgcaatgagtacatgggttttaggttgaatgtgagagtctgcagacaatgtgggttctccgactgccctcccagtgaaggtggacctctgatttagaccggcccgctgggcccgtgcctacatccttttcctcagcgtcaggatcttagtccccatgattgctgcccctttgtggtctgcatgtttcttggtaagggtgcccagtcaagtgtctctgggagccccctcttctctgtcatcgtcaggctccccacttgcagtggccgtggtggctgcacatgctcccggatacccctccagcactcccttttgtcatcttgagtttcagtccgtgacttgggtggcaccctatcttctccatcagggatggtagctatttttctgccatgagactagaggttgcttgagaacaggaaattggatctctcccttcaggctgggatttcactaagggctggagaaggggggaatatgggaggattatctcctatcacagggagcgctctgagggcaaggctgtgtctccgattcagactgacggttccctgaggatggggctgtttctcccctccgactggggctccctgaggatggggctgtttctcccctccgactggggctccctgaggacagggctgtgtctcccctcagcctggggctccctgagtcagggctgtgtctcccctcagactggggctccctgaggacggggctgtgtctgcctcagactgggaatccctgaagatggggccgtgtctccctcaaagtggggctccctcaggacagcgttgtgtctcccctcagactgcggctccctgaggacggggctgtgtctccctcagactggggctccctgaagaaagggctgcttctccctcagactggagctccctgaagatggggctgtgtccccctcagactggggctgcctgaggatgaggctgcatctcccctcagactggagctccctgagggcagggctgtctccccccttcagactggggcctcccccaaaggacagggactgtgtctcccctgggactaggttctttgtgtcttctgcatcagacagattcccatgaggacagggctgtctccccctccatctggagctccctgaaggcaatggcctctcccctcaaatgggacatttgcaccccaccccaccctctggctccccatggcgcccaggcattcctcccaggacacca

SEQ ID NO: 1933 - DNA, 2543 bp, Homo sapiens
gccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaacagttgagctctttacttttagtaagaccgacagaaatgtagtcagtaaagcacatgtagtgataggctatcagttatgtctgatacataagacagaataatatttcacaattagaaagtaccttagagatcatcttgctcacagtagatcattaatatcaataattaaagatgaagcttaatccaccatggtcatcagtcaggtggggcttattctaaatgcttaatgtgtcttaagctcatttccttgttcatatttgggttgctacttggctaaatcctttcaccttagtaccctaagccagtttcctggcttgatactatttgataatgctctgctcaggaatgattatattgggtgagaaatggagccctggggttgtgtgttttggaacagtattcaagatcaaagaaagttcttagtccatggttaatctgcaaggcatttaagccacttccatagaggagcccagattgttggttaaatatattgataatgaagtcaaagctgtggttccaaccccgatttttccaagaaaaatgacgtctggttatcactttgtacacgaagtgctaaccaggtatcttgataaattgtttacagtaggtattgagaaacctcatgtggattttttaatttggttagatgtgggatcacttttgaggatgaggccagctctctatgttctctttttcttcttgcagtagtccccagaaactcagtctgctttccttttctctcgatggctgtcagcacccatctaatgaaattgtcttctccaaaagactgactttaggatcagatacaattttcaccagtgttttttgtctaccttgctgcttctgaaaatatacatataagccttttaaaatgaaaagtttattaacttataattaaatagacgtagatgcatatgtgttgcattaggtgaaaagaaaaactgccagggagttataagaggaaaaactctcagagctcacactgagctgggagaagtttgaatgccaaccagttaaagtggaaagatcttgaacatgtggggcattgagtagagactcagaaaggttgtactttcataagagatccaaactggagctagactaaaggctaatgtataccaattttaagaaagcttaaaaataagccttgagagactcaagatgatctctaagtaacctcattttatctgccaaataaaaatagaacattccttaaaggaagaaaacaaaatcgaggcaggaaattgcctgaggctggagaaaaaatgacaggaaggagaaaggagtgatgaaaaattcctcagagggctgggcttggtggctcatgcctgtaatcctggcactttgggaggccgaagtggatggattatctgaggtcaggcattcgaagccagcctggccaacatggtgaaaccccgactctactaaaaatacaaaaattagtcgggtatgatgggcaggtgcctgtaattccagctacttgggaggctgaggcaggaaaatagcttgaacccaggaggcagaggttgcagtgagctgagattgcatcactgtgctccagcctaggcaacagagtgagactttgtctcaaaaaaaaagaaaaacaaagaaaaattcctcagagctcatacaaggctgggtagaatatgtgtttcaacaatagtggatcttttaatatagtacatggatcattgagtagagtcttcagcaaaatattggcaaagtagggttagggttaggttagggagatgggaatagactgaagactactctggacttgccctaacagagtttaagagcaacatttgaaaggatcaaactgatttcaagtaacttgagtgcatccaaggggagaaaacccatcaaaataaaaataaaaactacaataaaatcca

SEQ ID NO: 1934 - DNA, 550 bp, Homo sapiens
acacgccggtcaggattcgcgacccgacatggagcgtccccgcagtccccaatgctcggccccggcctctgcctcagcttcggttaccctggcgcagctcctgcagctggtccagcagggccaggaactcccgggcctggagaaacgccacatcgcggcgatccacggcgaacccacagcgtcccggctgccgcggaggcccaagccctgggaggccgcggctttggctgagtcccttccccctccgaccctcaggataggaacggccccggcggagcctggcttggttgaggcagcgactgcgccttcttcatggcatacagtgggcccctgaggttccaggtcctttgcggcggcgatctggagggcgtggctacaggacccgggatgccattcagttactcatcttttatgctttcgtcctgacctgtctcaactagacttgctcctgcaaccaccatgggggttttgcatttacatttgtggaccatgttacagttaagaaaaatcctgtttcagtccttatatgtaataaaatgttttatgatgt

SEQ ID NO: 1935 - DNA, 4686 bp, Homo sapiens
ctccggggcgatgagggactagaggcgccctgaggcccgcctgcctcccgcgctctggccaccccggcgggaaaaggatcgggcgggcgggcggtcccacagtgcccgcctttgcgccgccccaccccctgggggcgctgccgagggggcgccagccgcccatgccgccccggcgcccagccgcgcctggcgcccgccgctgaagcgcaggacgcgccgccgcccgcgctcaccgccgtccgcgccagccgccccgagccgactgcccttctgcccccaagatgtggcacagcgtcgggctgactctgcttgtgttcgtggccacgctgctgatcgtcctgctgctgatggtgtgcggttggtattttgtatggcatctttttttatcaaaattcaagtttctccgggaactggtgggagacacaggatcccaagagggagatcatgagccttcagggtctgaaactgaagaagacacttcctcctctccacacagaatcagatccgctcgccaaaggagggcacctgctgatgaaggccacagacccctgacatagtcctgtacttgtgaaggatgaaaaggcagttgccagcttctgtcttttactgacttcgctttgaaatttactaatgactgaagaacatttgtattggattttaagtcgaattttaaaaaagatttacatgtaagccatataaaaataaagggaactgaaaccaaattggactattataaatttcatcttaaagataatcttttgtttcaccagctttctacttatacacttattccttggcttttgggcttattttcttgcactggtgcagatctggtaaacattaaaggcttgaaaaaccatattttgttagccctaaaatgtacatttttcttcccattttaacttatctgaaattgggatgcatctcattactgtcaaccaggtgatagtcatgtaacgctcctaccgtgtgcatgtgtgaatttacagcttgtcatcgtgtcatccctttaaccaacatgtgttttgttggtatcaaatgtgtcaggtttaattgacattttaaaatgtcttcaaaaagatcacactatgattcagcattgaaacgaaaagttattgtgtatgcagaaaagcatggaaacagagcagcagggcgtacatttgatattagtgaagcaaatattcgtcgctggagaaatgatcgcaattccatattttcctgcaaagcaacaacaaaatgttttacgggacctaagaaaggtaggtacccacaagtagatgaagctgtactacgtttcgtcagtgagacacgtgcaaaaggattgcctatcacacgccaagcaatgcaattgaaggcaggagaagttgccaaaaccctaggaattgatgaaacaaaattcaaagccacaagaggctggtgtgaccgattcatgcgtcgagcaggactatcattaaggcatcaaacatcgttttgtcccaagctccccactgccattaaacagaagacagtgttggagcactctttcaagaagtgctgcataaccagtactcttgacaacaccgggagagacgttctgtggaaaaatgcagacatcaatgactgtggtttgaaaagtgattcagaagagttggattcagaatatgaagttataattataacttaaccaatttatttcacacattttctttacatatgcacaagattgatgtgataaaaatctgtttaactcaaagcgctgtttcaataaatataaacattttctgtgatatgaaagcattgtgtcatagtttaatgggcagtgttttttcttagtgatacatatggtgcatcttaacaattggtagtgtcttaggttaaattaaaaatggtagcttgtaaatttatttttctttttaagatagcagttatttattggggaatttgattctgactcttacaatgttaaacttgtaatcctgtgtgaaacacatgtttttgggggggagggggtaaccaagatttcagggtagtaacttaggaatctaagaactatcttctactttaggaagagtgggattagttactccctttgtataggaggactttatgctcaaggaatgtgttgtggagaaaaacacttcttcacaaacaattcagtgacaagacctcaaaggtaatgcgtattgaggaaaacagtagtgggtgaaaattcccgcttagctgtaaaatgactctcttgccaggtttccgtgtttgtctcaactgaactctgggctgagtgtttaccagggagaagagatgtgaattaaacaaccttcctgtttagtgttacctgctttgtacaagaatgaagtgcaaagccaacttactttattaatccaagttctttttatgtttttcttaacctttattaaggactagtcatcacaaaatatctatttaacctctattttatgatggtgtgttattatgtttgatacctcatacttcttgcttagagttttgtttaacagttcactggctctgtcccaatgtttgtgatgaacacctttttgctatattgtagctcttggagatactaaaagagaattcacagaacataactttagttttatgtgtttgctaggggaagatttcctagcagctgagagcaaggcacagtctctgtcttcatttctttattagatacaattttctatttttatgtgactctagggcataacaaaacagtgacagtttcaagcgttaattttaatgcttcctactagctaaatatcatcttaaaatgattatcagaaaaaaaaataatgcccccaaaaacttttgggggcattatttggtactgggaggatatttaaattagatttttcatagtctattgttttgaactatggattctgttttatggtggatacctaaggtttatataatagttgctggaaaacttaaagtagctggtgagcttcctgttatgtcactattaaagaatgatggctgatgtaactctgcccctgaaatctacaagggtcatgcccaaattaatacaggttaacctttgtagaggtatatatgttggcattatttattgacatttatgcttcaagcatgtcttattttatgtaattttaagaaatactctatttaacttgtgaaatatacctaaaagcatactagttagctcttagactctcacttagggagggtaaagaaacatcactgatgccaatatgaagatctataaacaaatcctttgtttagaacttttttctcttcgtgcacctcacaacacacttaccatggtacatatttcttaatgccactaagaaaggcaagatagtgaacgcagaattatttatgtggtatagtgtttgttttcctgttttagtgcttttgtagctaaaacttactggaactgcatcacaactacatttgcagtctcagtgggaggtggactagcctgtggttaattttagagcttaaaagtttataagcattaaaaacacatacatgtattagaatcttgtctaacccctcacaaaggatgatggtgatcagcatgccatcttttgaagattaattctaaaattgaggactctggtaggttgttttatttccttcccaaccagccattcatttccaattgttctgcctttgaaactttttgtgaaaattgcctgtaccaattgcattggttgcgttgctctgatttaaatgccaaaaacactaaatatttgtgtagtgctgttaaatgaggtttttgatatttccatcaaaatgaatataaaattcacttgatggattttgtagtgatgttttcacagttgaaacaaacatattgctgtgcggtggacagccacttcacagacatgcagacccatttctttagagatattaggtttaaaacccattttaattttattttgctgaaggtttggaatatataaagtaatggattcacaaaatatgatatcttaaaacatgttgaaagatttgaaagtggtgcatttttacttttaagagcagcaatctttgaaattagtcaacaatgcagtcttttttaaaagtcagttttctcaagtagtatgttgtaacgtaagatgtaactgatataactagattttgactggtaaacttaaagtgctttttatatttgaggttgactttaaaaagccattgagcagtcctcagaggttatggactctcaagcgactaatggaatagtgttctgttgtgaagtctagaactaaagcaccttgtattgtctgcttctaaagtgtcctatagtttttaacttaaagtgtaaagagtaacattttatcttatgtcaattaaagttacatttttcatttgttggtgtacatgtgctacctgttttatggggaatgtttaacacgatcctccaagttggttctatgcataaccattcaccaaatactgctgctgtgattccttgaaggaaatattctgtggtctgctatgatgcattgccatcttgctgcttgacaataggtttataaataattagaattacgtgttttaatagtacctttgtatatataacaagatgtaaaattaaagatgaggaatgtgtgtaaatgatcattcactgtttttgttttaaaactggtcagtactatgaagcttctgtggtttgtatgatgttttaactttcactttaaactgcatagaataaattaaattgaaaac

SEQ ID NO: 1936 - DNA, 2249 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1937 - DNA, 2230 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1938 - DNA, 2392 bp, Homo sapiens
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattggaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1939 - DNA, 2362 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattggaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1940 - DNA, 2290 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatggcgcctgcccccgcaaccgattggaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 1941 - DNA, 2473 bp, Homo sapiens
gcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 1942 - DNA, 2475 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 1943 - DNA, 2475 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctggggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 1944 - DNA, 2475 bp, Homo sapiens; identical to SEQ ID NO: 1942

SEQ ID NO: 1945 - DNA, 2475 bp, Homo sapiens; identical to SEQ ID NO: 1942

SEQ ID NO: 1946 - DNA, 2475 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttgggacagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 1947 - DNA, 2476 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctggggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 1948 - DNA, 936 bp, Homo sapiens
atgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctggggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtga

SEQ ID NO: 1949 - DNA, 586 bp, Homo sapiens
tgagtgtgtcgctgatgccatcaccgcagcgctctgaccgccccctcggtccagcatttctcaggctcaacgagttcatggccaagattcctaatcttttgttctgtttcatttccccgttaggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaagaa

SEQ ID NO: 1950 - DNA, 610 bp, Homo sapiens
ttttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1951 - DNA, 698 bp, Homo sapiens
ctttttgcgaagtgggctcgtgggttggcagtatgagagttgtaatggcccgactgttgagtgagggggagcaggggatcccaacggcttgcgctgcctttgcgcagcagccggcgggcccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaag

SEQ ID NO: 1952 - DNA, 847 bp, Homo sapiens
ttttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1953 - DNA, 712 bp, Homo sapiens
ttttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1954 - DNA, 1053 bp, Homo sapiens
gctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1955 - DNA, 602 bp, Homo sapiens
ggagcagcacccggctggcgctggccggccggcgccggggactttcttccgcctggccagacagatccctgttttttgtttttcaaaattcagaaagcatctccgaatatttgcccagaggagtgtgaaacatactttcctggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1956 - DNA, 962 bp, Homo sapiens
ttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagggcgcaatgccaggatctccctgcaacatccaccgtcagggctcaagtggtctttccacctcagcttcctgggactgcaggcacgtgctaccaccacgcctggctaatttttagtttttttacagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1957 - DNA, 847 bp, Homo sapiens; identical to SEQ ID NO: 1952

SEQ ID NO: 1958 - DNA, 610 bp, Homo sapiens; identical to SEQ ID NO: 1950

SEQ ID NO: 1959 - DNA, 712 bp, Homo sapiens; identical to SEQ ID NO: 1953

SEQ ID NO: 1960 - DNA, 815 bp, Homo sapiens
taaaggctgggtaacctgactcctcccctcatttctactgcaaaataggagtacactggggcctcccagtggagctgttctctgctgttttaaattactttctactcctccctttctaacgtccactcctggactcatttgttagatcaatatatactgggactgttgtgttttctttgagtgtactagatctctttccagaagagcttcccttgatccagatctccctaattgggaatgatgatttcacagactagagtctccgatgctggtcatgatgtcaaaactaagttctgactcatttagggaactggatacttgggtctccagaagggccaatgggagggccataattctgtttattttcaaattgtcttgttttcaccttgttagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaagaa

SEQ ID NO: 1961 - DNA, 952 bp, Homo sapiens
ctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagacagggcgcaatgccaggatctccctgcaacatccaccgtcagggctcaagtggtctttccacctcagcttcctgggactgcaggcacgtgctaccaccacgcctggctaatttttagtttttttacagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1962 - DNA, 585 bp, Homo sapiens
tctgagtgtgtcgctgatgccatcaccgcagcgctctgaccgccccctcggtccagcatttctcaggctcaacgagttcatggccaagattcctaatcttttgttctgtttcatttccccgttaggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1963 - DNA, 952 bp, Homo sapiens; identical to SEQ ID NO: 1961

SEQ ID NO: 1964 - DNA, 962 bp, Homo sapiens; identical to SEQ ID NO: 1956

SEQ ID NO: 1965 - DNA, 602 bp, Homo sapiens; identical to SEQ ID NO: 1955

SEQ ID NO: 1966 - DNA, 815 bp, Homo sapiens; identical to SEQ ID NO: 1960

SEQ ID NO: 1967 - DNA, 712 bp, Homo sapiens; identical to SEQ ID NO: 1953

SEQ ID NO: 1968 - DNA, 847 bp, Homo sapiens; identical to SEQ ID NO: 1952

SEQ ID NO: 1969 - DNA, 1053 bp, Homo sapiens; identical to SEQ ID NO: 1954

SEQ ID NO: 1970 - DNA, 585 bp, Homo sapiens; identical to SEQ ID NO: 1962

SEQ ID NO: 1971 - DNA, 815 bp, Homo sapiens; identical to SEQ ID NO: 1960

SEQ ID NO: 1972 - DNA, 610 bp, Homo sapiens; identical to SEQ ID NO: 1950

SEQ ID NO: 1973 - DNA, 847 bp, Homo sapiens; identical to SEQ ID NO: 1952

SEQ ID NO: 1974 - DNA, 962 bp, Homo sapiens; identical to SEQ ID NO: 1956

SEQ ID NO: 1975 - DNA, 1053 bp, Homo sapiens; identical to SEQ ID NO: 1954

SEQ ID NO: 1976 - DNA, 585 bp, Homo sapiens; identical to SEQ ID NO: 1962

SEQ ID NO: 1977 - DNA, 962 bp, Homo sapiens; identical to SEQ ID NO: 1956

SEQ ID NO: 1978 - DNA, 602 bp, Homo sapiens
ggagcagcacccggctggcgctggccggccggcgccggggactttcttccgcctggccagacagatccctgttttttgtttttcaaaattcagaaagcatctccgaatatttgcccagaggagtgtgaaacatacttccctggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1979 - DNA, 847 bp, Homo sapiens; identical to SEQ ID NO: 1952

SEQ ID NO: 1980 - DNA, 712 bp, Homo sapiens; identical to SEQ ID NO: 1953

SEQ ID NO: 1981 - DNA, 815 bp, Homo sapiens
taaaggctgggtaacctgactcctcccctcatttctactgcaaaataggagtacactggggcctcccagtggagctgttctctgctgttttaaattactttctactcctccctttctaacgtccactcctggactcatttgttagatcaatatatactgggactgttgtgttttctttgagtgtactagatctctttccagaagagcttcccttgatccagatctccctaattgggaatgatgatttcacagactagagtctccgatgctggtcatgatgtcaaaactaagttctgactcatttagggaactggatacttgggtctccagaagggccaatgggagggccataattctgtttattttcaaattgtcttgttttcaccttgttagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaagga

SEQ ID NO: 1982 - DNA, 952 bp, Homo sapiens; identical to SEQ ID NO: 1961

SEQ ID NO: 1983 - DNA, 952 bp, Homo sapiens; identical to SEQ ID NO: 1961

SEQ ID NO: 1984 - DNA, 602 bp, Homo sapiens; identical to SEQ ID NO: 1955

SEQ ID NO: 1985 - DNA, 815 bp, Homo sapiens; identical to SEQ ID NO: 1960

SEQ ID NO: 1986 - DNA, 962 bp, Homo sapiens; identical to SEQ ID NO: 1956

SEQ ID NO: 1987 - DNA, 952 bp, Homo sapiens; identical to SEQ ID NO: 1961

SEQ ID NO: 1988 - DNA, 610 bp, Homo sapiens; identical to SEQ ID NO: 1950

SEQ ID NO: 1989 - DNA, 712 bp, Homo sapiens; identical to SEQ ID NO: 1953

SEQ ID NO: 1990 - DNA, 1053 bp, Homo sapiens; identical to SEQ ID NO: 1954

SEQ ID NO: 1991 - DNA, 1053 bp, Homo sapiens
gctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatacttccctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 1992 - DNA, 602 bp, Homo sapiens; identical to SEQ ID NO: 1955

SEQ ID NO: 1993 - DNA, 585 bp, Homo sapiens; identical to SEQ ID NO: 1962

SEQ ID NO: 1994 - DNA, 610 bp, Homo sapiens; identical to SEQ ID NO: 1950

SEQ ID NO: 1995 - DNA, 739 bp, Homo sapiens
ctttttgcgaagtgggctcgtgggttggcagtatgagagttgtaatggcccgactgttgagtgagggggagcaggggatcccaacggcttgcgctgcctttgcgcagcagccggcgggcccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaag

SEQ ID NO: 1996 - DNA, 698 bp, Homo sapiens; identical to SEQ ID NO: 1951

SEQ ID NO: 1997 - DNA, 739 bp, Homo sapiens; identical to SEQ ID NO: 1995

SEQ ID NO: 1998 - DNA, 698 bp, Homo sapiens; identical to SEQ ID NO: 1951

SEQ ID NO: 1999 - DNA, 739 bp, Homo sapiens; identical to SEQ ID NO: 1995

SEQ ID NO: 2000 - DNA, 739 bp, Homo sapiens; identical to SEQ ID NO: 1995

SEQ ID NO: 2001 - DNA, 698 bp, Homo sapiens; identical to SEQ ID NO: 1951

SEQ ID NO: 2002 - DNA, 698 bp, Homo sapiens; identical to SEQ ID NO: 1951

SEQ ID NO: 2003 - DNA, 739 bp, Homo sapiens; identical to SEQ ID NO: 1995

SEQ ID NO: 2004 - DNA, 619 bp, Homo sapiens
cggttgcttaggggctgtagcgccggcagcgtgcattgttgtgggctgtgtactagtagggtaggagtttttgttcagggaccagcggaacgaggctttctgtcgttaataggtttctgggtaaatggcccaaccagagagttctgcagattttggcatagctcaacaaaataactattactgctactggcaaagtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcatact

SEQ ID NO: 2005 - DNA, 430 bp, Homo sapiens
ggccggttgcttaggggctgtagcgccggcagcgtgcattgttgtgggctgtgtactagtagggtaggagtttttgttcagggaccagcggaacgaggctttctgtcgttaataggctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcata

SEQ ID NO: 2006 - DNA, 741 bp, Homo sapiens
atattaacacaattattttctttttttcccccactgaaccttcccatttaccctctcccgcccactccacccgggcgggaattgtttccacgatgaaatgagtgaaaacctgagtgatcctgtgtctcccgtggtgcgaaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagca

SEQ ID NO: 2007 - DNA, 4134 bp, Homo sapiens
aaacgcgactctgccccggacccgcgaggcgcccgaggccttcgccgcttctgcagccaccggcgggggggggaacgaggcagtactgccgcggacgctcaccaaccgcttcggcttttcccccctccgggtctcctcgacctttcctgagagccggaatccgactgtagggggaagaaagactcaagagcagatgcttgaactgaaataactttattttggggggttactttgctgacccttagcgcagggcttcctttcccttccccctccgccgccagtaccaatccaactccccatctttctctttgtttttcctctttttctttttctctccctgttgccgctgtctccgcgtccttcccctccgttgccgcccagggcgccgagccagactatgggtcccaggtgggggctgagcggcggcagcagcgcgggcggtccagtcacggtgcgcactgcagcggggatggaggggctcagttggctggtggttttctcttgacatggctcctgcccgtgctaccagcagcgcccccgccgccgccgcctcttccgccgccgccaccgctccgcccgcaggctgcggctagagggcccaaaccccgccctagagtcggtccgtgagtcccgggctccgcggggacagggaggggatttccccgtcacccaccccgccctagctgcctcaattccaccccctgcccctcgggaaacaactaacgaccccaccctaaacaatccaaactctggaaacatggtctgttcaacgtgagagagagctaatccgggaacttaattttttggggggagggtgggtgggcttactttagaagtaatattaacacaattattttctttttttcccccactgaaccttcccatttaccctctcccgcccactccacccgggcgggaattgtttccacgatgaaatgagtgaaaacctgagtgatcctgtgtctcccgtggtgcgagtgagtcgctgccgctgaaggcaaggggtgggggtgggacctgcgggggtggaaggcaggtggtctccgggcaccgcctgggatttgggagaagaacccgccacctttgcctcggcaatgctcacaagaagataaatcgcactccccaccattttgaacgggggcagatccacagggaagtctcccttggggaatgtaggactagttgcaggctgggggtgttgggaacccgggcattaatcaggtctaaccacagagccggaataattaataccgtattatataccccttttccttctgccgtcatgattctccttggcagcagcgttagcagccgcctgagggtgaaaatgtgggtgatggggaagttggtaatgactccgctgttttttctcatggctcctttgggccacagctgcccgcccccggtatacactgtagttgattgcagggaaaccctgtacctctccctttccttctctaccgattttgcacttttctctatgctcaccaccaagtgtaatcaataacaagcactgacaatacatagcaatagtgaaatctgaaataactaagaattaggtactacagccatggagctggctgggtaaaatctaattggatatttcagtttcattcacctaccctgttttggtgtttggttttggttttggttttggtgagttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaa

SEQ ID NO: 2008 - DNA, 949 bp, Homo sapiens
agtcacggtgcgcactgcagcggggatggaggggctcagttggctggtggttttctcttgacatggctcctgcccgtgctaccagcagcgcccccgccgccgccgcctcttccgccgccgccaccgctccgcccgcaggctgcggctagagggcccaaaccccgccctagagtcgaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaaga

SEQ ID NO: 2009 - DNA, 992 bp, Homo sapiens
ttgcaacagattagtggtcctggtttatgttcttgactagtatgatgttatctggactgggctgtaaaaatctgtgaacactgttgctctgagttaggaacagaatggctggggcagaaccatttttggcagatggcaatcaggaattgtttccctgtgaagtctgtggaagacgttttgcagcagatgttctggaaaggcatggaccaatatgtaagaaactcttcaacagaaagcgtaaacctttcagttctttgaagcaaagattacagggcactgacattcctactgtgaagaagactccacaatccaagtctccacctgtgaggaagtctaactggagacaacaacatgaagactttattaatgcaatccgatcagcaaagcagtgtatgctagccattaaagaaggccgacccctcccacctccaccccctccatccttgaacccagattatattcaacgtccatattgtatgagaaggtttaatgaaagcgcagctgagcgacatactaatttctgcaaggatcagtcttctcgccgagtctttaatccagctcagacagcagccaaattggcatccagagctcagggtagggctcagatgggtccaaaaaaagaaccaactgttaccagtgctgtgggagctttgctgcagaacagggtcctggtggccacgaatgaagtcccaaccaagtcaggattagctatggaccctgcttctggagcaaaactcagacaaggatttagtaaatcttctaaaaaagattaactcctagaagccagactgcctccctgaaacccatcagcctggatggttgcgtacccgagaatgccacctaaggggaaggaacggtagatgtgatgtctgtttttacacccttgattcttcttgaagcatcacttagaacaagtaaaacttgcttcagatttttatttactccctttgaagttttcaaaacaaaagcattaaacacatcaacctgtataa

SEQ ID NO: 2010 - DNA, 461 bp, Homo sapiens
atggcaatcaggaattgtttccctgtgaagtctgtggaagacgttttgcagcagatgttctggaaaggcatggaccaatatgtaagaaactcttcaacagaaagcgtaaacctttcagttctttgaagcaaagattacagggcactgacattcctactgtgaagaagactccacaatccaagtctccacctgtgaggaagtctaactggagacaacaacatgaagactttattaatgcaatccgatcagcaaagcagtgtatgctagccattaaagaaggccgacccctcccacctccaccccctccatccttgaacccagattatattcaacgtccatattgtatgagaaggtttaatgaaagcgcagctgagcgacatactaatttctgcaaggatcagtcttctcgccgagtctttaatccagctcagacagcagccaaattggcatccagagctcag

SEQ ID NO: 2011 - DNA, 567 bp, Homo sapiens
cctccaccccctccatccttgaacccagattatattcaacgtccatattgtatgagaaggtttaatgaaagcgcagctgagcgacatactaatttctgcaaggatcagtcttctcgccgagtctttaatccagctcagacagcagccaaattggcatccagagctcagggtagggctcagatgggtccaaaaaaagaaccaactgttaccagtgctgtgggagctttgctgcagaacagggtcctggtggccacgaatgaagtcccaaccaagtcaggattagctatggaccctgcttctggagcaaaactcagacaaggatttagtaaatcttctaaaaaagattaactcctagaagccagactgcctccctgaaacccatcagcctggatggttgcgtacccgagaatgccacctaaggggaaggaacggtagatgtgatgtctgtttttacacccttgattcttcttgaagcatcacttagaacaagtaaaacttgcttcagatttttatttactccctttgaagttttcaaaacaaaagcattaaacacatcaacctgtataa

SEQ ID NO: 2012 - DNA, 930 bp, Homo sapiens
ttgcaacagattagtggtcctggtttatgttcttgactagtatgatgttatctggactgggctgtaaaaatctgtgaacactgttgctctgagttaggaacagaatggctggggcagaaccatttttggcagcaatcacatattccatgtgattcaatacacagaaacaaacactgcagaccacattgatctccctgtttgattcagctggctagatggcaatcaggaattgtttccctgtgaagtctgtggaagacgttttgcagcagatgttctggaaaggcatggaccaatatgtaagaaactcttcaacagaaagcgtaaacctttcagttctttgaagcaaagattacagggcactgacattcctactgtgaagaagactccacaatccaagtctccacctgtgaggaagtctaactggagacaacaacatgaagactttattaatgcaatccgatcagcaaagcagtgtatgctagccattaaagaaggccgacccctcccacctccaccccctccatccttgaacccagattatattcaacgtccatattgtatgagaaggtttaatgaaagcgcagctgagcgacatactaatttctgcaaggatcagtcttctcgccgagtctttaatccagctcagacagcagccaaattggcatccagagctcagggtagggctcagatgggtccaaaaaaagaaccaactgttaccagtgctgtgggagctttgctgcagaacagggtcctggtggccacgaatgaagtcccaaccaagtcaggattagctatggaccctgcttctggagcaaaactcagacaaggatttagtaaatcttctaaaaaagattaactcctagaagccagactgcctccctgaaacccatcagcctggatggttgcgtacccgagaatgccacctaaggg

SEQ ID NO: 2013 - DNA, 5293 bp, Homo sapiens
gttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggaaacttacgatcatctttcggaagtcccggtcacgcgggagcagttaaaccactatcggaatgtggctcaaaatgctcgaagtgaacttgcagcaactttggtcaaatttgaatgtgctcagtctgagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacaaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtacttctcatttagggagaaaatcgcagccctccttaggggcagattgagcatgactgggtccactgaggacaccattttggagaagattcgagaaatggacagccgggaagaaagcagggaccggatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaatatcttaaatttctggatcagctttctcagaaaatgaagttggaccagatggctgccgaacttggctttgacatgcggctggacgtggttttagctcgaacagagcagctggttcgtcttgagagcaatgcagtcattgagaacaagaccattgcccacaatttgcagagaaagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaagattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaacgcctattatttcatttactagcattttaggatccagaagaattccaccagattgcatgagttagattgggaaatgggagtgggagataatattgggaggtatctattttaagtcaggggctttactagccgatttagttctcacaataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctatgcagaatctgtttctcctgaatctctgtgatgctggtgggaattgtttgcatagaggaaggacaataaccctgccatcgtgagttaatgtccgggctggtcacagtggttcatgcctgtaatcccagcactttgggagtccaaggcaggcatatcatttgaggtcaggagtttaagaccagcctggctaacatagtgagaccctgtttctactaaaaatacaaaaataagccaggtgtggtggtgcatgactgtaatcccaactactcagcaggagaagcacttgaacccaggagacggaggcggcagtgagccaagattgtgccactgcactccagcctgggcgacagagtgaaactacatctcagaaaaaaaaaaaaaaaaaaaaaaaaaaagttaatgtccaaaaatgacagatttacaagtgtaagctatatgatttcttcaaaaagcaaaagcaatatacctaattcatttggatcaaacttacataggtctcaggtcctgtaagaaacttgcctgttctaactgttgctaccagattatatctggtggtaattgttaatgtttcagcagggctggtctcagtcctttaaaatggaaagctttatttggagcccaaccctataagatgaagaaatcctatatagtcttattcaccaatatatccaatacacccacagcaatggtacctttttaagatcaggattttattatgaattcctgtcactttctgttttccatttaaatttctattttacaaatttttcagggaatcatattcttaacttcactgagaaaaatgtgttactcttttggacaatttatcttatttctatcatataagatgtatttttttattgtccttaaaagaagctctagcatgaaattaaaggaaagggaaagaaatagatctggtgcacccgaacattaggagaaaatgaaaaatatacaaccaaccgttcgtgagtcatcaaaaagtcaaagtcagcctggccaacatggcaaaactccgtctctgcaaaaaatacaaaaatgagcccggtatgttggcatatgcctgtaatcccagctactcgagaggctgagacacgaaaattgcttgaacctgggaggcggaggttgcaatgagccgagatcgcgctactgcactccagcctgggcaacagagagagaccttgtctcaaaaaacaacaacaacaaaaagtcaaagtcataataagcaaattattggcttctttcttctagactaaaagaaattaaagagatgaaacaatcaattgcaagggtcaaaactagattggatcttggtttgaatgaaaaaaagcataaaatattcttgcaataattgtaaaaatttgaatgtggactaagtcctagattatattaaaatatttttaattttttaagcttgacaaatgcactgattgttatactttaaataactaaaaatctgagaatccacagtgctacagacaataagtgataaaatgggaaaaaatagtgaagatcttcttttaggaaaactaccaataaatgtagaatggatgattccaaaaaaaaaaaaaaaaagaagaaagagagaaagaaagaaacagaaaaacctaaaagaaagcgaatgaatttgacacctgttggttggatgacagaccacacagagggagagtgaccaggctttgcttgtggagcgggcatccctgcctagctatctccttcatgtgcaaggacagtataagtagtattttgcatgtgagtaaacacacctgcgcagccctggctgaggtcactaggctggccagaggcaggacaggcagtcttgaatttcctctaggggaggcctgcagttttccccaccaaccccttttcacatgctccaaagatgtagtagtgtctgctgttttggatcgaaaatcaccttgagtggaggaagtgacttcactgggtctctggaggctctcggagcttgagtggctctgccccaccctgaatcatgcacccataaatgcagttatgggtggatgtgggtgtatgagagtggagattgtttttgtacattctctttgttttcattttccaaatataatctttaataaacttgatttagtttcttgggaaatttattttctacgctattcaaagatattttaaataatattttaaaaacatgaaatttttttttcatttttgatttgatatcattaattttatatcaggattcatgtaagagactaaaaatgatccatagtggttagtactgtaatttctgtttattacatgaaattacattccatttatccaaatatatgtttatataatatttccactgtgtgactctagtgatctttaacatacacagaatgatctacagtgatctttaacatactcagaaatatgaaaaatgtttgaatatgatctttagggacttctaatgaaaagggtatatgaaatgggaacaataaattctgtacatgtatacagtccatatacacattaagtgtttgtcatttggacaaattgaaaacttttaataaagccattttcttctttgttaaaatgcca

SEQ ID NO: 2014 - DNA, 5304 bp, Homo sapiens
gagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggaaacttacgatcatctttcggaagtcccggtcacgcgggagcagttaaaccactatcggaatgtggctcaaaatgctcgaagtgaacttgcagcaactttggtcaaatttgaatgtgctcagtctgagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacaaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtacttctcatttagggagaaaatcgcagccctccttaggggcagattgagcatgactgggtccactgaggacaccattttggagaagattcgagaaatggacagccgggaagaaagcagggaccggatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaatatcttaaatttctggatcagctttctcagaaaatgaagttggaccagatggctgccgaacttggctttgacatgcggctggacgtggttttagctcgaacagagcagctggttcgtcttgagagcaatgcagtcattgagaacaagaccattgcccacaatttgcagagaaagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaaggcaagtgcttggcttcattttattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaacgcctattatttcatttactagcattttaggatccagaagaattccaccagattgcatgagttagattgggaaatgggagtgggagataatattgggaggtatctattttaagtcaggggctttactagccgatttagttctcacaataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctatgcagaatctgtttctcctgaatctctgtgatgctggtgggaattgtttgcatagaggaaggacaataaccctgccatcgtgagttaatgtccgggctggtcacagtggttcatgcctgtaatcccagcactttgggagtccaaggcaggcatatcatttgaggtcaggagtttaagaccagcctggctaacatagtgagaccctgtttctactaaaaatacaaaaataagccaggtgtggtggtgcatgactgtaatcccaactactcagcaggagaagcacttgaacccaggagacggaggcggcagtgagccaagattgtgccactgcactccagcctgggcgacagagtgaaactacatctcagaaaaaaaaaaaaaaaaaaaaaaaaaaagttaatgtccaaaaatgacagatttacaagtgtaagctatatgatttcttcaaaaagcaaaagcaatatacctaattcatttggatcaaacttacataggtctcaggtcctgtaagaaacttgcctgttctaactgttgctaccagattatatctggtggtaattgttaatgtttcagcagggctggtctcagtcctttaaaatggaaagctttatttggagcccaaccctataagatgaagaaatcctatatagtcttattcaccaatatatccaatacacccacagcaatggtacctttttaagatcaggattttattatgaattcctgtcactttctgttttccatttaaatttctattttacaaatttttcagggaatcatattcttaacttcactgagaaaaatgtgttactcttttggacaatttatcttatttctatcatataagatgtatttttttattgtccttaaaagaagctctagcatgaaattaaaggaaagggaaagaaatagatctggtgcacccgaacattaggagaaaatgaaaaatatacaaccaaccgttcgtgagtcatcaaaaagtcaaagtcagcctggccaacatggcaaaactccgtctctgcaaaaaatacaaaaatgagcccggtatgttggcatatgcctgtaatcccagctactcgagaggctgagacacgaaaattgcttgaacctgggaggcggaggttgcaatgagccgagatcgcgctactgcactccagcctgggcaacagagagagaccttgtctcaaaaaacaacaacaacaaaaagtcaaagtcataataagcaaattattggcttctttcttctagactaaaagaaattaaagagatgaaacaatcaattgcaagggtcaaaactagattggatcttggtttgaatgaaaaaaagcataaaatattcttgcaataattgtaaaaatttgaatgtggactaagtcctagattatattaaaatatttttaattttttaagcttgacaaatgcactgattgttatactttaaataactaaaaatctgagaatccacagtgctacagacaataagtgataaaatgggaaaaaatagtgaagatcttcttttaggaaaactaccaataaatgtagaatggatgattccaaaaaaaaaaaaaaaaagaagaaagagagaaagaaagaaacagaaaaacctaaaagaaagcgaatgaatttgacacctgttggttggatgacagaccacacagagggagagtgaccaggctttgcttgtggagcgggcatccctgcctagctatctccttcatgtgcaaggacagtataagtagtattttgcatgtgagtaaacacacctgcgcagccctggctgaggtcactaggctggccagaggcaggacaggcagtcttgaatttcctctaggggaggcctgcagttttccccaccaaccccttttcacatgctccaaagatgtagtagtgtctgctgttttggatcgaaaatcaccttgagtggaggaagtgacttcactgggtctctggaggctctcggagcttgagtggctctgccccaccctgaatcatgcacccataaatgcagttatgggtggatgtgggtgtatgagagtggagattgtttttgtacattctctttgttttcattttccaaatataatctttaataaacttgatttagtttcttgggaaatttattttctacgctattcaaagatattttaaataatattttaaaaacatgaaatttttttttcatttttgatttgatatcattaattttatatcaggattcatgtaagagactaaaaatgatccatagtggttagtactgtaatttctgtttattacatgaaattacattccatttatccaaatatatgtttatataatatttccactgtgtgactctagtgatctttaacatacacagaatgatctacagtgatctttaacatactcagaaatatgaaaaatgtttgaatatgatctttagggacttctaatgaaaagggtatatgaaatgggaacaataaattctgtacatgtatacagtccatatacacattaagtgtttgtcatttggacaaattgaaaacttttaataaagccattttcttctttgttaaaatgcca

SEQ ID NO: 2015 - DNA, 464 bp, Homo sapiens
gtcagctcaggctccaaatatgtaacaaacaggtggagaggtatgaagaacgaggaacactgcccggggagtttcttcctctgcaaaataagggagtgtgtactgaattaccgtttccagctccaacatccaggatttcagcactacctgcagagtagtgggaggagagatagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaattt

SEQ ID NO: 2016 - DNA, 1018 bp, Homo sapiens
cgtgtacccggaaggtcgtcagctcaggctccaaatatgtaacagtgagtttctaagtgagtcacacggacgcggttggtttccagtgaggcataactcatcgcttcactcttctcaacggttccctcttcggaaggaagcgcagtccgcagcgtcgtccgagggcgtgatcgcctgcgtcgcacccgcgtctccagtggccaccccttgtcctacaggaacgcgcatctgcttagcaggcgctgagcccttgaggaggcctaaaatgaatgaacgcggctgtgcctcctgagcaggctcacagttgtgggtgggggacagaagggtgtccatgcctaaggtcgacggcgataagacagacgttcttcccaggaggagatcagttccagagagacggaggtctcgctatgttgcccatactggtctcaaaattcctggcctcgagtgatcctcctgtctcagtccctgaaatgctgggattacagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagatagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaactttta

SEQ ID NO: 2017 - DNA, 1904 bp, Homo sapiens
cctcaataaacatggccgccacgccagcgtcaacccggctcgggaggccgcgctgccgcttgggaatcgcaggtttggcgtcacccggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattcaa

SEQ ID NO: 2018 - DNA, 637 bp, Homo sapiens
gacccggttgcgatcgagtggccgacgcccccagtgggagtgaggcccagcacgcgagctcggtccctcttcctggagccaggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggca

SEQ ID NO: 2019 - DNA, 1645 bp, Homo sapiens
gtcacccggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagaga

SEQ ID NO: 2020 - DNA, 578 bp, Homo sapiens
gtgctcgcgctcgcggttctggcgctgccggaccatgctgtgtccccatggctttcaagctgaagaaatgaaggtctaaagtgtgtcagacgtacctaaagaagagttcaaaagtgtagctgccatcctttccttagctatcagaggaagcagtcactccagaatgagacatacacaagcccgggttcatagactcaccctccataagctgtgttgctagattgaagtttttaatcaccagtgaagaattgattgtcataattttaggagactactgaagtttgccttgtttctttccctaggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagtt

SEQ ID NO: 2021 - DNA, 1743 bp, Homo sapiens
ggagccggggagcgaggcggggaggctgggagcggggcgcctcttctgaggccagagggggctgggcagggccggcccggcgggaagggggtcggccgcgcgctatcagcgcctggtccctgagccgcggcgctggcggtgggggcttttcggccccggcccctcctggcagggcccggctgtgcaggtggccgggcagggccgagggccccgcagcccaccgagaaggccccgccggcctctggcccgcccacccggcgacctgcgctggggccgcttgcacggccgccgcgggttgcagccttggagtttagtttcatcttcggattttccttcagagtcggagtgggagtgggacgcaagttggtggtcttcttcggtcttttaaaatagtctgggttgacgtcaaatgcagaaatgaggcagtgttgattttttttggcgaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaa

SEQ ID NO: 2022 - DNA, 1818 bp, Homo sapiens
gtcacccggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattc

SEQ ID NO: 2023 - DNA, 2182 bp, Homo sapiens
cggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcatcccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagtca

SEQ ID NO: 2024 - DNA, 1762 bp, Homo sapiens
ggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcatcccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagt

SEQ ID NO: 2025 - DNA, 2871 bp, Homo sapiens
gttccaagggctgatgctgggaaccttgctctggatgcgaggcctgcccctggagggagccgcggaggactggcagctgcagatgctggagcaggccagcctgtggctgggccgtagcttcctgctggcaggcttcctggtatcgagcagctgccccagcctggagcaggcggccaagggtgagggctgttcccccatcccttgtttcgcccactgcctcgactccctggtgagaaactttctgtgtcaccctcacagtgtccagatcatcctgggcactgccagggccacctgcagccatttctaaggctctgtggaggcccagggactcctcacccagctccagcgccagcgcagcctcctagcccaccagccctttgaggagctcttggaccactgggtctcggcctaccacctgctggagtggctggtggagcagcagcagccccttcaagagtacaagggcaggcaccagctggggaaggctggtgttgccttgtcggccacattctggagcccggcagacagcctcagcaagctcctgtagcccttccagatggtggtccgcgaggcgagtgcggcacaggcctctctgagccaggtgctgccccagctgcgctacctgcacatcttcctggagcaggttcacacacactttcaggagcagagtgtcggggagaggggcgcagccatccagctggctgaggggttggcccggcagctctgcaccgactgtcagctcaacaagctcttctaccgcgaggagtttgtgctggccaccttgctggacccttgcttcaaggggaagattgaggccatcctgccatgggggccgaccgacattgaccactggaagcaagtcctcgtgtacaaggtgaaggagattagagtgtctgaatactctttgaactccccaagtcccctgcaaagccccaggggtctgtgcgtggaccccaccagggtagccaagagctccggggtggaggggagaagccagggggagcctctgcagagcagcagccactctggggccttcctgctggcccagagggagaagggcttgctggagagcatggggctgctggcctctgagagaagcgggggctcgctgtccaccaagagccactgggccagcatcattgtcaagaagtatctgtgggagaatgagaccgttggagcccaggatgaccccctggcttactgggagaagaagcgagaagcctggccaccatctatctgtcttaccccccacaggagccttctctgaaagcatctttgcctccctgaacagccccacccttgtagagcaaaactcttctctcaaggtggaagccattgagcatctcctcttcttgaaggccaacctggagcagttccccaactacaccccgcctcccctcatctgctctagtggtgacctggccaaggggatacagaccctgcagtccgctcagggtgggatggcagacatggcaggtgccggtgctcaccctgcccgtgaactcctagagagcccctgcctgtaataggtcaaagcagagagctgggtgttgcatcctgggcgccacatgctcatggccagaatcttaaacctatttggtaggaaagggtcagtttctcacttgacagattgccatatttttttttctgggagatgtcattttccatctcccgattacttcctttacgtctagcagtatgtgccgagaagaggcttactctcttcgtaggtgactgtgaattttgtactacgtggctttgtacatgtgatgctctgttaaaacataagtgggtatgaaggtccttgcatacaccttgtctgtgtggataagtggacacatgcccttaagaggcttgctttctcaaaaagtggccaaggatgtggagtgggcatgtgctggcaggtgggatatgtcctcagcctttgggggcctggataagctattgcagcactttctgaggctttcactgtagggagaaggaaaccccaagggtagaatagccatttccagagggaagtacacacatacccccacacaccagtctttttgggggtttcagagtggccggagaaaccgactgaagggactgaccagctagctaggagagctgagacgccagtcctcaaatggcgttcttaccaatagtctatttccagactactggaaacgttggggtttcttcctccagtgacagcagcctcagtagctttcctgggctccaggcggctggctgcacaccctgcctgccatcacccttgcccctgcttgtcctggaccacttttaaaggggaagtcccttatttggaagagagaaaggatgtgtgtagcacacactcatcatggattgctcagagttcctttagggcagagctgagggcctgggatccaggaaccagtgggattggatgggagaagaaggaagggggtggcccgtcacccccgcaagacttgcatccaggtagcctaaggactcctggtcactgggtagggtggctgctgagatgcaggtcggaagaggcaggggaaggctccaggcctaacttggagcatgtcactggccatgggggtgaggggacagactctgctctcactggctggcagccccaggagcctgttcccttgcctctcctggatgggttgtcagccctgtgtttcactgtgaccaattcattataacatttggatattactgaaaatgtaaggaagcaggaaaaattaactactttcattcagagatagcctctatcaatagtttgacatttttccctcttttacattgagatcataccctaggtactgtttagtatgcaatattttcattttcgcagtataataattgcacctgttaaataaagttttgtaaacattt

SEQ ID NO: 2026 - DNA, 2673 bp, Homo sapiens
tcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggtatgtccagacccccgaggcaccgcttgcagggcagtgacagcccgtgaggctcggcctcgacccctggcacccttggtcccagctacgccggctcctggccttcccccaagtccgagagagaggtgggattctccccgacgcagttggaaaccgggaatcccctttagggtcccgttcgtgctgcactactgactccaccatctgcaaagggattcttgtccagaatccccgaaggctttaggacagcgcttattttgttgaatgaagagtctctaattttcggaaagaccacaggctaaaagtcaagttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacatctgtcgcggcgccatgttccccaccttcacgtcacctgaggacctctacacgggcattaaagcccgcacccagcagccctttcctcccacggtgccaaccaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaactagaaaaatt

SEQ ID NO: 2027 - DNA, 3357 bp, Homo sapiens
agagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacatctgtcgcggcgccatgttccccaccttcacgtcacctgaggacctctacacgggcattaaagcccgcacccagcagccctttcctcccacggtgccaaccaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaactagaaaaatttatagtctttaatctctcatcttcagattatacaaggaaattttccaaaatcacaaaaagcaatgtgtacaacaaagtttacatcattgtttcaccaaaaaaaattgaaaagctggaaagaactcaaatgatcaataattaatgaatgactatacaaattatagtatcttaataaaaatgagaacactgtccctttatgtaaatttttgtacatagtagcattaggtagaaaagacaaaacccaaacacctagttaattgagggatggacacctctaaaaactatattgtcttaaaagtatgtggactctgttcctttatgtaaacatgtaaagaaaataagtcagcgaaaaaaatgaaacccaaaactctctgcatgtacacattacaaattgaattgtttgcttacccttaaccttctgattgagaaacataactgtttcttttatgcagataaaattattttactgaagatctagcaatggccttaattagcaactggtgagttctaattatagcaagaaaggatggcttggtatcagttattacagagccccaaatcttcatttctggagtgtgttctctaagagtttggctaactcccatatgcaagtcaattcatttaatgtgccaagaggtagattttaaacatagtctatcgtggaagttcaagaggaatttctttaagtattttgtgaatatttattttaattttatgaccaacatgtcatttggttgtaacctccttaaaactattctgggctaaagttagagaatttttttccaactgcattctgtacagcactagttacattatgacaggaagtaaaagtttacatggtgaaataatactggggaaatcggagcaacaatgtcagttgcatgccttggtcactgggttctctatagcctttaatatgtaatgcaattgggagtgtctgaagtgagggagatatagtgtacacactttttatcacagagtagatcactggaatggaattccaaataataaactttggaaggtgtaactctccagtat

SEQ ID NO: 2028 - DNA, 757 bp, Homo sapiens
gaagagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgaccca

SEQ ID NO: 2029 - DNA, 555 bp, Homo sapiens
agcagtgtaaaatgtgttttctgcctgccttgactcgacaagccaaatgtgccctccttttcttttccaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacat

SEQ ID NO: 2030 - DNA, 519 bp, Homo sapiens
ctcggcccgcgaaggccgccagctgcggggaggggaggggaggcgcggtcccgcagcgcccccaggctcatgtcccagggtcccgttcgtgctgcactactgactccaccatctgcaaagggattcttgtccagaatccccgaaggctttaggacagcgcttattttgttgaatgaagagtctctaattttcggaaagaccacaggctaaaagtcaagttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatca

SEQ ID NO: 2031 - DNA, 1354 bp, Homo sapiens
gagctgcaggcaacgtgatctgaattacatggaggacaagctccagctgactttccgtaaactcgcattaggattctaataggagacgacaggagcaggtggggataatgagctggcggaaggggctgcctatcacactgctcggtggcccctctttcacccccactttgcctcaggcattttctactcagctgtgaccttacttatggtgatgccaatccagtggtcaggagcgaggcgcccagcctgtgtctgaatcctcctactgaccctggggatccgtgcgacttgatcttagatattggtggtgaagcgccgctctccttgacagcatccaggaaaggtaattacctttgccaaaatgcaagtggaagttcaaagcctcagccttgaagagtgtccctggagacttccaggcccccaatgtgaatgtgaagccctcctgcccagtggggcaaggcgccggattgaccttcgcctgagtgggagggcagtcgctgtttgggtccacgttaggggcggtccaggtcaatttaacttgtcatatgccacgggaagacataagaagccaaacccacaccaaaacatgaaccgggggatggaatttattgctcctgtatcagctcccaccaaatctggtgccccgtggcattttctttctcaaggtcccacggatgcccagagagcagtcagaatcaggccaggcaccaggatgggcttgtcctcagatccagttgtcggcaccttgtcttccagttacctagatctgctaactctctcttacaagcctgggaggacagtgacaagttcatacctaaacgtacgtgggcatgaagtaagaaagctccagaattctgttgaggccacaaggatttccagaactgacagcagttaagaattttgcagaatctaagagtcacatctctaaatttgtgtagattgtgaaatctcttcttgcaagaaaaaagagaaatagctgaagttctggaaataacagttgatgaaaacttggtaatctgaagtctgaactttgaacaccagcagacaggctgagaattctctttgatcatgagcccaagttccacgtgtacctgcaggaatctgtgtggcatttgtgcactggtgtggggcccaggagaggaccacggagtgacaagccaccaggttctaaagggagacgaagatccccagaggacctggatagagatgtttccctgaccattgtctgctgtgtgctcccgatgatgagactctagagtttacaactgaaacacactgtcatttatgatattatttgtaatatctggtatgtctaagtaaaacatgcattcagtaaaactcgcgatgaaactta

SEQ ID NO: 2032 - DNA, 5937 bp, Homo sapiens
gggagcgcccaggaaaatccgggcgcccgcgggggtgccggccgctcctcccgccgccccgcgtcccggcccggccgcgccaacccccacggcggcccgcaagggggcggggggaggcggggcggaggaggagccgcgggcgcggcgccgcgctgtccccggccgccgcccgccccactccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaactc

SEQ ID NO: 2033 - DNA, 5605 bp, Homo sapiens
aggattttgaaggcaaaggctctggtttctccttccccatgtctgaaaaccgcccttagcctgcacaaggtgaacagtggaaatcattggtgaggaatggccacccactgccctctttactgtgtaggagcagatctgatgatgaacagagcaggtgagcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaac

SEQ ID NO: 2034 - DNA, 1376 bp, Homo sapiens
atggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttc

SEQ ID NO: 2035 - DNA, 1277 bp, Homo sapiens
atggccacccactgccctctttactgtgtaggagcagatctgatgatgaacagagcaggtgagcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttc

SEQ ID NO: 2036 - DNA, 1187 bp, Homo sapiens
atgcacaaaaagagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggaggg

SEQ ID NO: 2037 - DNA, 2520 bp, Homo sapiens
ggttccggcgctgccgggtctcggttcgggttcgttgccccggtgccgggaccgggccggtctctccggccgccccagccgggcgcagcagccggaggtgtcgggaccctctggacccaccctagcgggccccgccggcggtcggcctccggtccgggctcccagtcgcgccgtcctcgccgccccatggagtcccagtgcgactactcgatgtacttcccggccgtgccgctgccgccgcgcgcggagctggcaggggatccgggccggtaccgggcgctgccccggcgcaaccatctgtacttgggggagactgtccgttttctgctggtgttgcgctgccggggcggtgcggggtccggcaccgggggcggcccgggcttgggctccagaggagcctgggcagaactggcaaccgccctggccgccctggcctcggtcagcgccggaggcgggatgccggggggcggcggcgccggcgaccaggattcggagcccccagggggaggggatcctgggggtgggggtttgttccgaggctgcagcccccttctcacccacggcccgggccctgctacctcagggggagcgaccacgctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggagaa

SEQ ID NO: 2038 - DNA, 1472 bp, Homo sapiens
ggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtgtaccttcagttgaatttttagaatctcccattacggcagtagacagcccattcctaaaagcatttcaagcatcatctagttcttctccagaaacgttaacagatgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgcctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 2039 - DNA, 888 bp, Homo sapiens
ggagggggcgcggtaccgggagggaacggggcgggtcgggcttcgaggtcagctggtccgcagggaagcctttggcttccccaccggcaatggagcggttgacgttgcctctcggcggcgcggcggcggtggacgagtacctggagtaccggagaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattgg

SEQ ID NO: 2040 - DNA, 1136 bp, Homo sapiens
ggtccgcagggaagcctttggcttccccaccggcaatggagcggttgacgttgcctctcggcggcgcggcggcggtggacgagtacctggagtaccggaggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatgaagactattggagaaattaaaaccatcatccaagtatctttttcatgtttatttaaatgtaataatacagtttatttttcctgaaattatttactttttttttttactgtataaatgtcttttgggatgtttccttaatttatttaaataactaaaaatgcctattacttttgtcaaaactcataatttactactttgtatgtacctttctttctcctgacaaatgaggttattttatatgagtctgtctgagagtacagtaaatgtttttagtacataataatttaactgtttcaggtatttaaaaaattaaagatattatcaagggttttggacaaacatatgagccatttttttgtcattcaaaatagtaagttaaaaacaagagaacaaaagaaaaaaatagttaaaatcattaatttttttatttttcaaactttgtaatgttatgttttcaaataaaaactatctcaaaattttacaacca

SEQ ID NO: 2041 - DNA, 1274 bp, Homo sapiens
gccggaaggcggcgtccgcgacgcagctgttcacgcttaggtgggcgacgtgggcgcaggtgggcgcaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagca

SEQ ID NO: 2042 - DNA, 2131 bp, Homo sapiens
gcgacgcagctgttcacgcttaggtgggcgacgtgggcgcaggtgggcgcaggtaggcgcgtggggcggcggcggggtggccggcgggtcagggcgccaggagacccagagccccggggcgggctcccgcggggctccgccccctccacgtgggtgcgcggaggcccggcgcggcgcgaccgggcggcggccctggggtccgcggtgctggggaggctggtgcggccggtgcggccggtgcgtcccggcgcgggctccgacacccgcacccgcctctgggttaactcagcgcgggcgagtggaagggactcagctggctcctaggtttcaggccgtcagggcttgcagtggctctggtttcattgtctttctctgaagacgccctgattgccctccgaggctttcagctcccactttctctttttcaatttttgaggcagtgtctcgctgtgccacccaggctggagtgcaatggcgtgatcatagctcactgcagcctccacctcctgggctcaagccgtcctcccgcctcatcctcccaagtagctgggaccacatgcgcgcgccaccacacccggataatttttaaaaatgttttttgtagaaatggggtctcaccatgttacccaggctggtctcgaattcttgggctcaagcgatggatcctcctgcctcggcctcccaaagtgctgggattacaggagtgagccaacgcgcttggcctcactttccatcataagcatgctttccgtttccttccttccgtcattcattcattcatttttaaaaaacgttcattgggttcctcctgcactgttcggggcattgggctacagctgtcaacaagtggagacaagtctgtgatctagtgaacttccattctggaggggagagacagatgaacaaggtgcacagagcaggtgatggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagca

SEQ ID NO: 2043 - DNA, 1264 bp, Homo sapiens
gccggaaggcggcgtccgcgacgcagctgttcacgcttaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcagccgtgggtcctgctctgt

SEQ ID NO: 2044 - DNA, 621 bp, Homo sapiens
cctgccggaaggcggcgtccgcgacgcagctgttcacgcttaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgc

SEQ ID NO: 2045 - DNA, 2125 bp, Homo sapiens
gttccgcggcgcgctgggagtttgggtttggttggctgcagccagccagccgtgtaaaaactccaacgccgggcgccgcgggcagcacccacggagacccgcggggagctgctgcagctcctggcaactggtcaagcaggcagcgtccagcgcacccgcgaacaccaggtccggcagcatctgtcttttcccgcagcgtgcagcgcctgaccatgaggaacacaagcaaggaacttcagggcgccacgcaccgctacgctccctgcgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaagctgaggctaccggccattgactcaaagtatctgagcaaagcaggcaccccacttggccctaagaatcctgcaggaagtagactctccttcccccccgtgcctggtcaaaaaaacagttcacctaccaatttttccaaactcattagcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccagagtcttctcaaagcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattaga

SEQ ID NO: 2046 - DNA, 2122 bp, Homo sapiens
gttccgcggcgcgctgggagtttgggtttggttggctgcagccagccagccgtgtaaaaactccaacgccgggcgccgcgggcagcacccacggagacccgcggggagctgctgcagctcctggcaactggtcaagcaggcagcgtccagcgcacccgcgaacaccaggtccggcagcatctgtcttttcccgcagcgtgcagcgcctgaccatgaggaacacaagcaaggaacttcagggcgccacgcaccgctacgctccctgcgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaagctgaggctaccggccattgactcaaagtatctgagcaaagcaggcaccccacttggccctaagaatcctgcaggaagtagactctccttcccccccgtgcctggtcaaaaaaacagttcacctaccaatttttccaaactcattagcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccagagagtaatacatgcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaatt

SEQ ID NO: 2047 - DNA, 1925 bp, Homo sapiens
gatgttgtggttccgcggcgcgctgggagtttgggtttggttggctgcagccagccagccgtgtaaaaactccaacgccgggcgccgcgggcagcacccacggagacccgcggggagctgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaagctgaggctaccggccattgactcaaagtatctgagcaaagcaggcaccccacttggccctaagaatcctgcaggaagtagactctccttcccccccgtcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccaggcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattagagtaagaa

SEQ ID NO: 2048 - DNA, 605 bp, Homo sapiens
gtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctcca

SEQ ID NO: 2049 - DNA, 3981 bp, Homo sapiens
aatcagtttgcacttttgggtgagggtccacctccaaggctgtcgctccggttcctctgcctcctctggctgctgcctccgcagctccctcctcctaccccacctcctccatctggggagcgtctgcgggggcctgaggggcggcggcggcggcggcggctgcgatatggagccaggggccggcggccgaaatactgctcgtgcgcagagggccgggtccccgaacactccgccgccccgggagcaggagcggaaactggagcaggagaagctctccggtgtggtgaagagcgtccaccggcggctccgcaagaagtaccgagaagtgggagattttgataagatctggcgagaacactgtgaggatgaagaaactctttgtgaatatgccgttgcaatgaaaaatttggcagataatcattgggcaaaaacttgtgagggcgaaggtcgtattgaatggtgttgtagtgtatgcagagaatatttccaaaatggtgggaagagaaaagcacttgagaaagatgaaaaaagagctgtacttgccactaagaccactccagccttaaatatgcatgagtcttctcaacttgaaggtcatttaaccaacctcagctttacaaaccctgaatttataactgagttgctacaagcctcaggaaaaatcagattacttgatgttggcagctgctttaacccatttctgaagtttgaagaatttctaactgttggcatagatattgtacctgctgtagagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaagaaatgcagaggtttacagagtttgctatttttttctacttctcaattttaaaatttattcttatatagaaagcttaaagtttcatgcagagtgactcatgtcatagcagaaactactgttactttagcatttagcactatcatagaaaggtacctttttctctttagtgctattgtgaaaacaagcataatttgctatatgttttccttttcaacttttcagtgttgactataaaccattgaatggaaaactttaagatgtagaaagctgtagattgcactttgatgactcacaagttaaatgtgatacagaaaaatagatcggttagttgttttgtgatgcacttatctttttcttttttctaactaaaattgtgatgttacagaaagtcattttatgttccttttttgtctgatgatccaatatttactgaactttttgtaattggtgataattctttttatttcttccttatattaaaagctcatttgacagcatcagacattgggggagagatgtcccccaaagtgtgtattctaattttattagccctatccaataaacaccattgccaaagtagtattttcataactttcttgttgatttgggccttggtgtgaagtatatttacctgagagttcacttttacttttcttaaacttaggcttcatttacaaaatgttttatttaagcaaggaacaatgtaatactcaataatgacctaaaacacctttttgaaagggtttgcacttggaagagagtttatgttctgttgaaaccaactttgatagggtcctcacctttccgttaaggaggtgccgcactacaagtttcaaattatatggaaaaacctaaaattaaccctctgttggtgatctcataaaatggttttgaccttttggtatcttaatttctatctaaactttatcagaaaattttctttgaatatatcaattagttggctgtgggaattttccctttccacattaataaatgcctttctgtgtttctgaatcagaagcaaatgattagggaaaaatatatgtccaaacaagacaagattagtttaaacagttaagaacatttagtccacattgtcttgtcagccagcaattgtcatggaagctatcatttttaagagtgccactgtgtggatttttttttcaagtggttattacattaaaattacctcatactgaggtttttgcactgaaatatcacagtttcagatttcatggttaatgttgtgcgtatgtttgtatgtttttaaaggaaacttgcattttcaatagttgatcctaaatttcataaactgcacttctttactctggtaaagctgatgtttttgtgcttattgtgaattgccgtagtacctttgaatgtcaaactttatttagaaatataaaacttatcctttatgatataaatggttgagtgtatgtacccagtatttctaattaaatttcacatgctaaattaatgaaagtaacaagattgtaattttttaaagtcagttgattaaatgcaataaatattggttgctcaaatatgccacaaataactcgaaatttttcatttactttcaacagcataagattctttaatatttaggattgactgttctttccagttaagcactgaaggattatgtcttgtagcttccccaagagaaggggaaggaaaaaaaagcactatgttaaggataatacagaactcttttgaactattttggtagtaccttttaccatactgtttgctttttgatttgggtaaatatcttaagagcaaagaaaacaatacaccaaatgaaaatgctttgaaagtaaatgaaaacagcgcttttgaaaggctggtatagtatgaccctggagtcagcctttgtgttacagcgaaaatgttggtgctataaattctgattgtttacagatgttgattctgcttatgctccaaagtgtgcatgatgtattttacgtagtactctgaggaagtctctttataaaacctactaccacttagtataaatttgtttgaatttatatcatttgttactgtaaattcagcttattccaattaggttggcacagatttaaactgatacacattccacaaaaaccaattcagtgtataagtattgaagtataagcagtcattgcagcttgatgccagatcatgtatgtaataacaagtggaagttaatagggccttctaatactgtatgggtactcctaagaattatttcattttggatataaagaagttatgaggcctcctgtcacattcacagctggttctccaaaataatttggttgtttcaaaaacaaatggtaatcatttggttggattcttcagtatcatgactagatcatgtggttttaccatagttgccaagtggtgggaggtagcatacctgaaaatgtacgtgtgtgtttgttgtattttttcacattttgtgaacaaagcacatttattaaaaattttaaattttctagta

SEQ ID NO: 2050 - DNA, 1298 bp, Homo sapiens
gggcctgaggggcggcggcggcggcggcggcggctccgcaagaagtaccgagaagtgggctttaaacacagctgctttaaaattttgaccaagtccaagaccttaagaaactttgaacagattcttttctcaatgggagattttgataagatctggcgagaacactgtgaggatgaagaaactctttgtgaatatgccgttgcaatgaaaaatttggcagataatcattgggcaaaaacttgtgagggcgaaggtcgtattgaatggtgttgtagtgtatgcagagaatatttccaaaatggtgggaagagaaaagcacttgagaaagatgaaaaaagagctgtacttgccactaagaccactccagccttaaatatgcatgagtcttctcaacttgaaggtcatttaaccaacctcagctttacaaaccctgaatttataactgagttgctacaagcctcaggaaaaatcagattacttgatgttggcagctgctttaacccatttctgaagtttgaagaatttctaactgttggcatagatattgtacctgctgtagagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaaga

SEQ ID NO: 2051 - DNA, 1004 bp, Homo sapiens
gtaggttctcacctacttcgactcctctccctgtcccagggaggggagaaaaggtctgggattcattgccaggaggggcttcccccaggatttcctacttctttctttactgctgtgcttgaagctcacaggagacccctcaagaggtggtcaccggcccacagcccaccccatcccccacccgccacccccaccgtaccaaatgctagctctgccctttcttctgtgtttttcccatcaagagagatggttgtggtcatgaagttcttccgatgggttagacgggcttggcaaaggattatttcctgggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactccggaggctgagttgctgtgggaggtgtacctggtgctgtgggccgttcggaaacacctgcgccggctgtaccgcaggcaggagaggcacagacggcaccacgtccgatgccatgctgccccccgacccaacccggctcagtccctgaaactggatgcccaaagtcccctctagggggaaccccagacccttagagagtcctgacctcactcttacctggggtcccatatcagccccttcattccatgtattccagttgtaaaacaagtatcaaaatattgggaaataaatatcagatagttctgagtcag

SEQ ID NO: 2052 - DNA, 1023 bp, Homo sapiens
tggcagttgggagcctgatggaggacaagtagggcctcgaggacaggtgcgtgacagaagcacaggaaaaaaaagaaaaatgaagaaataaaaacacgagttcatcagtaaagaggtaccctggcagcataaatattatgataagctaaaagctggaatcatctggaaaaataaataagactcctcatgtccttttcggtccataaccagaagggcagcaaaaggcctttgccactggaacctcttctttttctccaagtcccacgtagcaattacctgcactttcaagaagagaaacaacgactacacctaaagaaattccttcttgataggatgtttctagtggccaagatacaagcaaatgtagaaagaaaagatgttgctgactactatgaacaaatgtttcagtcagttttgaaacatcacctaggagaagcagtgacaggattgctgctcatctatcccacttccattctgcatatcctcgagtcctccagcgacactctctacaaagttcttttagattatattggccatgtcaaagatgaaacagtattttttattcaacaaatgaaaattatagtcatttctcataacattccaatgaggctttttatgcaatggcatgtttcagtgataaaagttccagttatgtatctcgacgatgtgacacagtcacagtccctaaaggaggtcatcacagattttctcacacaaactcataaactgtcactctacctttgccagactatgaaagtaggcactaaaggaccaggcgataacttacaccaagttgcacctgacctactcctcccagaacaaatcataaagtacttgtgcaaatccgaagaattcatggacccggcaacatttataaacatgtataatagacccatacacatcactctggattctgaggtggtatggcctgctccttcacgtttctaggattgagagggataatgtgcccatgtctcttaaggagtttgtgctacttaaataaaaaaaacatttttaaagtta

SEQ ID NO: 2053 - DNA, 3762 bp, Homo sapiens
agcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgtaagtgtattgttgatttttatcatgcagaaccaccaaagaagcatattccaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactct

SEQ ID NO: 2054 - DNA, 3902 bp, Homo sapiens
agcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgtaagtgtattgttgatttttatcatgcagaaccaccaaagaagcatattccaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaa

SEQ ID NO: 2055 - DNA, 1489 bp, Homo sapiens
gaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaa

SEQ ID NO: 2056 - DNA, 3032 bp, Homo sapiens
aggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctg

SEQ ID NO: 2057 - DNA, 2911 bp, Homo sapiens
cttgcatttggcagacgagtcacccgggcagtgggatgaggatggcaccaacagagtcaacagaaggaagacggctctggccgggccccagggagggaggcagcggtaaggaaacaacttcagagaagttaagcaacttgcccaggccacacagctattcaccaaagagagctgatgctgagtctttcagaggagtgcctgcagcatttaaaaaatgcagagaagtgttcagagcctgctggggaagcagggagctgctatttctgttcaaggcaatcagtgaggctggacctgcccagaattcatgtggaatcaccctagagaaggctggtggcttggaagacactggatctcactggctcagctgggcacggtgcaaggtgctatacataaatggtttcactgacccctggaaggatgctcaggcctggatactcattgtgagctgcaaaaaaggaaaggggacccctgagagggaaggcaggaactagggctcatggccagaggtgtggagctgcattgaaatctcttgagtgggatgcccatgcttccccaccagatcccagaaactcaacgtagtgtcctgatgtcctgactggctctgcagaagcccaggtgtcactccgggtgagtgggctcagatcctccacggtctacatcctccaggcactctgggcatccccgtcctctgggtggggacagctttctagctgtgctgggtgagggtgattatagccagcaatcctggctgggccttcgttcttgatccccggtaaaggcaggggctacagggtgccctggtgcacagaggctcactggctgctcaaggtctcctcccacaaccatctacatcctgactcagcgctgaattgtgatgctctggaggacaaggctggtgctcccacagtgtgtacctgccttcctggaggccaggatgccaagaactgcctcctagccacccgcttcttccaggcccttagaactccagccagagggctgcctgtagggcctgcttctgtgcagctgctcagagcagtgacagcactccttaccccgtccctgtctaccccacaagtgctgcctgcttacttgggtcgtgtccatgctggcctctgctcttggggcctggggagccagagccaccaaggacggacaggccagactcaggaagcagcctgtggtggggcagcccacctacactcgcccctcccttgagccttctcacccggcagcatccctgctggatgcaggttccctccatgcctccacccaggggcatccccacccctcattgcgaccgtctccagagcccttccttccctgcaccatccctgctccttcatctcctgccctttgcctgccctacctgtcgcctcagcaggcactcacatgggcacatcttggcctccctcctgagggccctgcccagaccagccaaaggaaggcaacctcaggcggcaccaggcagtgactgggcagtggggacaaggaccacaatgcccgtggctgtaggtgtcatgggttggggagggggtgtgggttcctggacctttgccctggtcctggggtgggcaggtggggttcctggttgaccctgcacacagcctccggggtggtctccagaggactgtgcagtgggggcagccagtggcagcctaaagagtgcaggatgggggtggggggtgcccactgaaacaaatgctcaagagcagctggttatggcaggactttaagtatatattcctgtacatcttttcaaacatatacacaaagcaattcacattttcatatactggaaaggcaggctaacttttcattttcctgcaacatgtgcatagtaataaaaaattctggccgagcgcagtggctcacccctgtaatcccagcactttggcaggccaaggtgggcggatcacaaggtcaggggttcgagattagcctgaccaacatggtgaaatcccgtctctactaaaaatacaaaaattagccgggcgtggtggcatacacctgtaatcccagctactcaggaggctgaggcaggagaattgcatgaacatgggaggcagaggttgcagtgagccgagactgcgccactgcaccccaggctgggtgacagagctagactcagtctcaaaaaaaaaaaaaagttctatagccttcttccagtttctccccccaattaaatgtaataacaatctaatcagtgcactgaaagttaagataatagaaaaaatttcatccagaatcccatcacccacatgttaccgagggagaaattttaccacctcttgtttcaggccagttcaggcaggtgtacattgtctcagaagggagatatttctttcgtctgatactggagagtcaccagagtcgccagacaacaggacaggacactcatcttgcccacaggctaggtttgctggatgtcactaggtttgccagacaccaactcttgtcagagttattccatttgcctgtttggaaaaggcagccttcacccctgcattcctagctcctgggctgacggcctgcctgacatctgagggtagtggagtgaggttggcacttgccctgcgctgagagtggaggggagataatggtttaggtgggaaagtacagcccctccagcttcagggatcagctcacagcagggggaaaagtcctagaggaagactggggtggggcatgtctgctcactcacaaaagcagattcattattacagggcctttaaagagggatgtgtgtgggtagatgggatcctcaccgaggtgtgacctgctttttctagtgtttgcgaggatgtctcattaacctgcaggaaagtgctggtttcaattcgatggtttgttttctgttctgtttcctttctgttacaaacacaaagggtacattaaagagcctttccccatc

SEQ ID NO: 2058 - DNA, 1956 bp, Homo sapiens
agcagtaggatctcggtttccagcccagtgcaatttctgctctatcccgctgacctcattgttgaggtatgtccttatagcagtgtgagaaccgactaatacagttccttaggaagcccctgctgggtatggatggggagtgaagcaaggtgggcccagaagctgccgctggctgagagaccatgaagaaagtgtatagaatctccaccatcaccagaggaagagagcttggcaggaaagttacttccatgaatggatgagttgaagtgaacagcgtcttgggcaaaactgaagggtagttagtcgggtttgtctctggtgggctttcagctccactccctgcatcccattcccacatcgtgatggtcccctcataggcccagggctaccaccttggagcataggtggggatcctccagccagggtccttccttcacagggagtcagagccctctgctccggaattgccctgccccaggtcggccatctatcaaaagccccactatcccctaaagacccaccctcaagcagcagatgtgcagcaagggagccgcaaatgtcattcctgtgaccccgaagcagtctagtgtgttacctctctcagggctgctatgggctgaattgcttttccccaaaatttctatgctgcttccctaacccccagcgcctcagaatctaactctggataggacctgtgaataagtgattaagttaaaatggggtcctgtggatgggccctaacccaatctgactggtgtccttttaagaagaggaagagacaccagagatgtgcacactcagagacaagacacatgaggacacagagacaaggcggctacctgcaagccagggagaggggcctcggggaagccaaccctgcctacgccttgatcttggacttccagcctccagaactccagaatctgagtgaaatgggtataaatcatgagctaggatacagttcaattattcctatgatgaaaagagctttctccgcatgtgggactctcggcctcattatgagtggcatctttgacaatccagggcccattaaaaacaccttgaagaaagcattcaccatgctgtggagcttcacagtctataccaggctggaatccttgagggtggcattatcaaatgaggaaatggttcctttcatttttcatctgaagactcagacagcaaacatgttatctggccctataagcaccccgatgcttctgtgaaacccaagcaagttctgcatcaccacgacagccgcggatgtcaaatcatcaaaacagcagcagaggaaggggtttattcctcctccaaatcttcagctggttttatagggttaccagtttaaagtttctttgttttcagagcatcagacctcccatttgtagctgatagccatttttcaaaggtttctggctcacccaggaattcattagggtggacgagaaaagaacagtggatagaatagaccagcagggcaatctaagccccattccctgtctctttacattggttcttggtccccgtgactcatccaaactcccttatattcctatctggaatgcgaaagctggaaatacaagtgctctgtaatcacaggcagtggttttcttggagtctggtgtgatttctgtagcttgcagcaatatgtgggacacacttgcactgaagaatttaatgacttgttttactgctgtctgccatcaatatttatctatattaactgaagaaaggcattactcgaaatggcatttcacacctctgagcattatacagtaattctaaagtcatacgttgtaccaaattctctgggcaaacacagagatacagtatgaatggaaagaatccaagttgaagtttttaaaacttgaattgtctgcagtaatctggaaaaccaaagtcaaaatgactcgaattgctatggctgggaatgactggattaaaagcaatggaaac

SEQ ID NO: 2059 - DNA, 2028 bp, Homo sapiens
gaattatcagaaatactttatagttatcaaaaattctaaagaaaaaggccatggatgtagaaattcaggacacacctggaaagataagtatctctaaaaggtccatcctttcaggaactgttgagaatatagattacccacactattgtgatctcttaagaaaaatgaacatgccttttgtgaaaggtcttgagaacagacataactatggcaggtttgaaaagaaatgcaaccctgcttttcttaaatttcacccttatcccccttcagttttgccagactatcatttacatgatccttatcccccaccatatgggccacattatccattatttccacttcgggatgatgtgaccttaggtgattcctgttcagggtttatgagtcctggtggtgatgctgatttaaatcctggcattggcagaaccataccaaccctagtggattttagtgatgtgaaacctcaacatcgagttcccagaccagacacaggatttcaaacaacaataaaaaggcaaaaaattctatcagaagaactgcaacagaacaggagatggaattccagggaagtaccagacatttctatcagagcaagacttggaggttggacaagccctctgaaagttactcccttacaacctcatcatgaaggacgctcattaagtcacatatttacatttgatgaggaggcaacatgtacagatgaaggtgaaccacttgttcaaacaaacaagaaatgtaatgcaaaggactcattttacaagtcctctacacaaaaagcttatgaagatgttccttgggataagatgctaccaccaaaacttgttccagaagaaacaacattggaaaaaaccgctgaccccatctcacagtgttttactctgaaaagatataaaggggtgccagcaataactcagatggttggtgagctctgggacagatttcaaacaagatctttcttggcaccagtcaaaccaattaattttgtgagttcaagttctagaagtaaatatattcctctctatactggtcatgtgcagtctacaaatgctgatgatgttgacaaccccttgggagacatcgcatcgctagccaagcagcggtactctaagcctctttatacaaacacaagtcgtgctgcaaatattccaggatataccggcaaggttcatttcacagccacccacccagcaaattctaatattccatcaacaaccccatcaccagattcagaactgcaccgcgtcttccagaaagaaatggcagttgacctcttccgtcaccaggctcccctgtctcgactggtcacaactgtgagaccctacaaccctttcaacaagaaggacaaagaaaccatagactactagaggaggcggccctgcgcgggctgtccaggcctccgcctggggaaggcttgtgcggcggtgggaaataaaggctgcttctccgcgctgcgcagtgtggtgggttcggtgctgttctccgctggcctgcgcgtccctgcccagcccgcctctctcccccggcaggcggcgctcagctggacactgggcgcccgccagccgcggcgcagactcccaagccgccggcagcagggtagcagggcctgtgttgcagaagattcctctttagggttggaatattgggtctacctagaggtttcacatggcaccacttcagtgcagggattctagagcagagagcagaccatagattttagaatctcaaaggcagtctagtcaaaaatccgtatgctgtcagtgggaaccctgagctactgagaaagtgcgttcttcttttctagcaggggacatcacacaaggggacaacatctaccctctcttggcctgctccagtgtttccttcagagagaagtgttccccagtccccatgagggtcctgaagtctaagtcaggaccactttgggttagagtgtggcctgacccggccttgaccaaagagagcaccagctcgcagaatctctcaggggtgcatgtgggctgagggggagccctctggccttcggaa

SEQ ID NO: 2060 - DNA, 1262 bp, Homo sapiens
gaccggcccgcggagctgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagttttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccac

SEQ ID NO: 2061 - DNA, 1222 bp, Homo sapiens
gaacagactggattagtgaaagctactgcagtgctttggacacttactatgatttagacttgcaatctacctggaattgatgtgagtatggtgtgagacagaacttcaggttgacttttggttctctatggatacccattagacccagtagatatagaaccatattcatggcaccagtgactgaagagtccacgcactccccactctgctgcagtgtcaccgtgatcataaatcaagtgggttgggatttccagttccttgatgaagagaagttacgagactgggcatccttgctttgttcctaaacaggaggtgaaaacattcagtcttctgccattaggtctgccttattattttcgtcagtgttgtgcaggagaatccacttagaagcctgggtaaaattgtattacatgatcttgggtttggtccctgagaaagagccagattaacgctggcaggaaagaaagcaggagtgcccttcaaacacgctgctgaagggcaactggaggttccggggaaatgtgaagaaagaaacgcaaacacccctaggaaccagattgcatcttggaactgaggaggttctggaagctgtacacccaaggaagacattctgtgccggagagagagtgggagagatgtgactgctgctggctgggtgaggacaggcccagaggacagcatcactggcacccacccctgcatttgggtcctctgcacctcagctcccagcatctgggcctcctccctgcctgcctccccccctcactcaatctgtctccactcaagaggctgatgggcaggtctccctgcttcttcaaatctttcaaagggaaacttcacaaagacaggagccctgacccatccaccttggcctcaccccaccccagcacggaagccaggcggccagtggaggccggtagtgctgaatggacatggggctggatgaaaagacttccgcctgcctctctcagccccggaatcgccatgagctgctattccggagattctatgctacagaagtacaaggtgaagaatgcataccgattacattggcaagggagagaagagcctggtgctagcacttttgcttctttggtctttcaataatgtctttccccttgattatacatgatatattcctattttggaaacttcgaaaactataaaaaagtcaaaagaataatattaccactcagaaataaagatcatcaagttttggtgt

SEQ ID NO: 2062 - DNA, 883 bp, Homo sapiens
gtctgccttattattttcgtcagtgttgtgcaggagaatccacttagaagcctgggtaaaattgtattacatgatcttgggtttggtccctgagaaagagccagattaacgctggcaggaaagaaagcaggagtgcccttcaaacacgctgctgaagggcaactggaggttccggggaaatgtgaagaaagaaacgcaaacacccctaggaaccagattgcatcttggaactgaggaggttctggaagctgtacacccaaggaagacattctgtgccggagagagagtgggagagatgtgactgctgctggctgggtgaggacaggcccagaggacagcatcactggcacccacccctgcatttgggtcctctgcacctcagctcccagcatctgggcctcctccctgcctgcctccccccctcactcaatctgtctccactcaagaggctgatgggcaggtctccctgcttcttcaaatctttcaaagggaaacttcacaaagacaggagccctgacccatccaccttggcctcaccccaccccagcacggaagccaggcggccagtggaggccggtagtgctgaatggacatggggctggatgaaaagacttccgcctgcctctctcagccccggaatcgccatgagctgctattccggagattctatgctacagaagtacaaggtgaagaatgcataccgattacattggcaagggagagaagagcctggtgctagcacttttgcttctttggtctttcaataatgtctttccccttgattatacatgatatattcctattttggaaacttcgaaaactataaaaaagtcaaaagaataatattaccactcagaaataaagatcatcaagttttggtgta

SEQ ID NO: 2063 - DNA, 1499 bp, Homo sapiens
cactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactgggtcgctgtcaggaagatcatagcaccctttccagttcaatcactcaagagtggtggagaagtcatatgccaaactgtgtcattgtttggcgggggatggactgagaatcagaggaaagggtctaaatttgttttgctcataccttcaggaaaagaataaccattgtctagttgttgtcttaaataaccttaggataacactgctgattttgattagcttctgtgtggtgcaaattactagacaggttgaattgggagtttgtgtgcagttgttttcagacattttgaactcaaacacactgactagcacagttgtaatttaatatatttaaactacttattttggattttagacatttgaatgcctagtaactaaatggaatagaaagaatctataataaagggattcatagatgccaatgttgaaatatagtgattctgatgaatttcctatctaagacaaatttagaatcattatttaaaattagaatcattatttaaagtatttttaaaagccaatgcaagattgattgttggaaagatgttttcttgacactctttatcaagtttattcatttgaattatctggacagtgtttcatttatttatcccctcctctctgactactataaaatcaacccagattacagatgagcactttgtagctgatcatctttgcactgccatttgatgaacatgttggtaacggttgcctgccttatgtagcatgaacagttgattctgacaatcaagatcctctgcctgctgcagtggtccatacatgaacagctccccttcagcgccccagctattccaggactcttctccattgtaagaagacagaaatgtgtctgagatctcatttatgagacaagatcacagcagccactgatataaaaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattttttatatcatttttattaaaaaaacttaagttagactctt

SEQ ID NO: 2064 - DNA, 1272 bp, Homo sapiens
acggacctaccactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggcatgaacagttgattctgacaatcaagatcctctgcctgctgcagtggtccatacatgaacagctccccttcagcgccccagctattccaggactcttctccattgtaagaagacagaaatgtgtctgagatctcatttatgagacaagatcacagcagccactgatataaaaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattttttatatcatttttattaaaaaaacttaagttagactctttttctgtctgttgagtgatttatttattatgccttaaaactgacttgtcaatgtttcacataatggtttaaagggcattgaattcgaaattttagaaaataattgtaaaaattcaatttttttaaaagaatgaaggttggaaatagcatatgtatcattaagtatattagagctaatcaattggtcattgtatagactttaaaatttatgactttaaataatatttaataacatggaaaattatattatggcattaaaaattagcataatacaccatatatggtacaatcgtagttgtattaaaaagttacatatgcataaagatagactggaaggaactgtaccaaaatgctgacagggctatttctggagatgggattatgggcgtttttcattctctttttaatatatttttccatatctcccaatttttctaatatgacaagtattgtgcgtaattagaaaataataaatgttaatataaaaaa

SEQ ID NO: 2065 - DNA, 1875 bp, Homo sapiens
tgcgtggtatcaagaggtgcattgaggcgctcctgcagcctcctcccggcacgggactcctcacaacccccagcctcagcttccctgacagggcaggggctcactcttctccactccgggccaggaacgcagcctgcttgccttttgtccaattgggtgctctttctttgcgactgatacaaagtgggaacaaactccgcttccggtgatgcccgggccccaggaggctgggggagaagtgcacgctgcccagccttcaacctgaactgcccccagcacttccgagccccgacccctgcagctgtgagggaagccccgacctctgccctggccacatccttcccctgatctcatggctgaaaagccacaccagaattcctgcaattcagtgaggcagctcttcaaaaccaagcagctggtgacgcacagggacagagggagctgtacgcacagggcccaggggctgctggctgccaggaccaccgcattgcagaggtctcccttgcagcaagagatctgggagtccacaacggcacttaacctgccctctgccctggcaccccagggactcactgccaaagacgctcactttctgggagacacagaccccatccaggaaggggcacgagaccacgctgcaggaggccccttccaagaccgccaagcatctgtagcagcgcagaccctgagctgggagagagggcaaggattctctcggcaccacgggaaccaccttctctactctcactgaacacccctgggatgtatctgtaaaaattggaacacctttcggctagaaaccagaggaagccgctcatgacacccgggagctcacagaggctctgaagtttctattcaagaaaacaactccagatggggctgatctggaagacaagtaacatcttccttttcttggtgctcgcctgccgtgctctaggtgcttttagagatgctggtctgtgtgctagggaagcgatgaaccatactgttagtctattaaacataactcaacctggctggctttccatgactaccaaacgctgggaatatgccagacctgtgcccgtggaagactctggcctcccagcacacctccaggaacaaactccctggcccgcaggatagggatagcagccccaaccgtcaatacaaagggattttactgagtgggctcatgggttctttaagttccccctcttaacgatcaacggtaattcaaacgtcccaaaaggagaaatgctttcttagcatatcttttacctggagtatttccccttctgcctttacagcaatcatgccagttctaccacttttgcaagaaagctccaagagagtcagtgtagctgaaactttgtcactgggtcacctatctagtccatatgtctgcaggaattatactgataaatggacaactcaccatgcaatcaatctcccgctctatcctgttccctgaccggcatggtttctacttcctgtcagcacaactaggacgtctggtttctgctgggctgccctctcatgggaagcctttaatcactctagctcaatatatcctctggggaccatcaacatttcctattaaagataactacacctggccgagcgcggtggctaacgcctgtaatcccagaactttgggaagccaaggcgggtggatcacaaagtcgggagatcaagaccatcctggctaacacagtgaaacccctcctctactaaaaatacaaaaaattagccaggcgtggtggtgggtgcctgtaatcccagctacttgggaggctgaggcaagagaatggcgaacctaggaggcagagtttgcagtgagctgagatggtgccactgcactccagcctgggggacagagctacactccatccc

SEQ ID NO: 2066 - DNA, 2677 bp, Homo sapiens
ccgcccgcgccccgcccgcgccccgcggaacctagagtcgcaggcgcgttcttgaaggacggaattcggcgtcggactctgcgccccgcgtagttccggtggcgactgcggcgcatggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaaggaatattgtactcagtctttaggattagattaagtggctgttggtaacaaagattagtggagaagctgtataatcgtacactggttttcacttttgaaaggaatccctgtcaaatggtttagtgcttaatgctgttatgtcatattgccctaatctctatttttgataaaattggataaggagtgaaagagtatgctgaccacctatgttagaggaagtacagaagatgcaggggtgtggtatccctgggtccagtccctcacctggtacctttgtgcatgttgccttcattcctgagcaggtatcatcctcagggaaccagcatggcacctaccaggccaggctctgttcttaggagcaaggagcttcttgcgctaacagttctggcctgagacctggattgagccttggcagacttcttgtctaaatgttggccattcagtctcaggccctctgttccatggaattgggaatctccaggtgacctaatcctcattggtggcttgatgtttgctggtatcttccaaactcagttcccagactagattgatacctggagcccagctgcctactcagcatttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcccggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtgcagcctggcatttggggccactactggtctccgcgtcttggtggtagtggtcccccaggcccaggtgtcttttctttta

SEQ ID NO: 2067 - DNA, 2281 bp, Homo sapiens
aagaaaatgaaacagaattgaaaatggtcttgtaaaattccacttggggtggcgatgctttgtggcttgaagtgtaagggatgagaacagcatgtgaattccaagaaagcaacacagaatggaaaatggatttacaatgtgtcagacagggaggcaacatcctgtggcatgtggcttgcatctcagcggtgggaaagaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacacctactaaatcagaatctctgtggctgggactctgaattctgcatttttcatactttggcttctttcctcatctataaataagtttgaatataaaatgtgagtctggagaaaaaggaaggctaaaatttgaagaaatatacatggagaagacatgcaagacagtgtattagtcggttttcacactgctataaagaactgcctgagactgggtaattgtaaagaaaaaaggtttaattgactcacagttccccatgtctggggaggcctcaggaaacttacagtcatggcagaaggaaaaggagaagcaagcactttcttctaaggagagagagagagcagtgaaagccacacatttttaaaccatcagctctcgtgagaactcattatcaagagaacaacaagggggatatctgcccccatgatccaactacctcccaccaggcccctcttctgacacatggggattacaatttgacatgagatttgggtggggacactgagccaaataatatcagacaggtcctccagactgtgggttcaatgcttacaaaatcaaaacacaaaacatttagaatcaatttagccagtaccctctaattacattttagatttttaaaaacacaaataaataagctaaaaacacacaagcaaacaaacaaccaaaccaaaccaaaccaacaaaacaacacaaatgtcccaaataaagaaataatagccaaagtcacagatgaaagctaatgctgtcataaaacattaagacttccccacttgggtttgggtcctagttcttcctgaggtcttaatgtctgtaacaataggtaatttggccctgggtctccttaaggcagggagattgagatgatgacacggtatagagcctgtcacctgcaaggactgactcaggtataaaaagggaaataaaatacctgtactctctaactgtggaacaagccatgaaatttgctattggtattagactttgaacgaaaaatgtaaagatacacatagggaatcaaactctcagctctgtactttggttattcggttcaaacttaaactatctgtattgtcagaaaccccacattataataacaattggccagcttcattaaaattcacagggtcctctcatgtgtaaatgtaagaactggggcatttagaactcccaaagatttaaatatcaactcctgctgaagacgagctctcaatcaaattacaagctgcctgaaaagttatagtaaaacaacagagtcagcaaatgctaaaaacactagaattagaatgatgagaaaggaaagaaataagacaatcagaaagagaccatattaaaagtatgcttaagatatttaaagatatagatcaggcgcaatggctcacgtctgtaatcccagcactttcggaggccaaggcgggcagatcacgaggtcaggagatcgagaccatcctggctaacacggtgaaacgccgtctctactaaaaatacaaaaaattagtcgggcgtggtggcacacgcctgtaatcccagctactcgggaggctgaggcaggagaatcgtttgaacccgggaggtggaggttgcagtgagccgagatcacaccactgcactccagcctgggtgacagagtgagactccatctc

SEQ ID NO: 2068 - DNA, 3652 bp, Homo sapiens
gcccaggtaaagccatgttttcctacacttaaaaatgtaaataaatatcccttagataatctggacagcagtttcttatatagcatgtctgagcactatattttgctgggctataaaaggtttaattgttgtttattggtacaataagggattctagttactaatatctacctgtagtcaataaagcaaacattgattggttgatcgaatcattgattcattcaataggtattgattcagcaccagctatgagctaggcagagttctaggccctacagagaaaactgatatcaaactaagaaagtctttttccaagtgctacagtaggggtgggggaggagagagataacaaactggtgagcaaatgttaaacaaaatgattctagagagtgctaaatactgtgaggaagataaaatgataaaataataaagacttctgaagattggttagggtaacctcttgtagaagtatcattggagaccgaaggatgacacaccagccatctgaccatgagagaacatcattcaaggcaaaggaaacagaccaccaccaacaaaaaaagatgcactggggaatttccagtaacacttttgttagctctcttaatatctgattttttgagcactagaacactgcctctcacagaatcctagcttaaaacagcaatgaacagactagaattctaggctaaaaccaacaagatgaaatgtgactgatatgaatataaatggtgcacataagttcacaaacccaattacacagcacaaaatgatatccacgtggcttgacagctgttcatattagaaaaatctagggattctaatggactacatattggagattgctctttgctgttcctgactggaaaaaaaaatatgtagatattacccttgggcagatttcagcccaacttaaagtatcattagagctgtccaaaatggaacagcctgctttgcacatagagaactcacattgctcaactcaaaaaagagcagaaggaaggaagaaggaaggacacgtaacagggatttttacaaaaacagaattcggtatttcttggagactactttaagacagtttttggtttctgtaagtctgtgacttattacttgttcctttaattccaataaaattttcttcatttttgttatttttaaaacattaagaagaaaaaaatgatattgatataaggtagatggtgaagtttagcaaaagtttagtttataatgatatctctcaaaatagcaaactgaagtttaaaattcttaagctataattttaaaggaatttagattaaacttttaatatgttgttggctaagtataatacaaaataaaaactaaataaatcttggttttgccacatattagctgtgtaatatagacaatttacttctctgttattgtttcctcagaatgagggcagtaacttgtagccgtctgaaaagattgttataagcatggagttagttgctgtatataaagcagttagaccagtacctgacaatattacatgctaagtaagtgcttgctattactgttgctgttattattaattataattgtgtgctctattctgccttcaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataactttgcttaaaatttttctgtattttaacttgtctagggttttctacttcttctatttttataatattttctcattttttagattactaaacattctacttatccacatgtgccaagatgtgccatttaggtctctgcagaaattagctgtttggtatcatcacctgccatacatgttgtgtgcagcagtgagaagtatattctctaccactgctctttctcatgattattttctctattcctattaaaatgaataattgatatgttaattaagtaaagcaaatcaataaggaatgaaatgcatggcccaaaacatagaaaatgaaaatcgtttgaccatttatccaattattgaacccaattaagatgatccattttaaatttaatatatgctcgcttttggaatgtgttatgcattgatgttaagtgaatggatctaagtaaatctattgatatctcta

SEQ ID NO: 2069 - DNA, 3571 bp, Homo sapiens
gccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctgggtaattttaaaaattaataatttctcattttcttctttgacattgtaaaaaaaacgtgtggtgattaagagattttaaaagttttgaatagccttgtcttagggaaaagaaaccatttagtacatattttatttacattagactcacataaagttgcatgtaagaactaaattgaaataccctaagcatatgaatatttattagactgtattttgtgctttgtgtatgctgcactttaccttctgactacgtaatgaagcgttattctgtgtgcaactgtgatcaaaattcaagtctgtctgctttattctctgataataattgccttgtttacatctattgtctataaaatatacccaaagtacatatttcagccctcactccaaaatgtctaccttttattttgaggatgctttagaaaaatagaataaagttgaaaggggcagatagtaaattcaggttttatgttttccgtaaatgacgggaaagtttgcagagatttcaaagtttcttcaggcctgttactttcatgaaaccttattaatcttgtatatgtaggatatctttttatattttttaatgtagtatatgtatgtttttgcttcatcagaaatctcttcatataaatttttaaactgaacttctctttggaacatcatttttctgaagaaagaaaatgaaatgttatttcagagtgatccacatataaaacaatgagttttgaagtcagtggtatcaattattctgctacaaataaagagtatgattttcaaatactttataacaatatgctgttgtattttatttagaaagagaataaataatataattatttgaaagccttaaacacgttttacatatagaatatggaatctcagaaaaatataggccattttctgaagtttttgttaaaaatgagattccttggttttaagtgtttatggcagtaaaatactatcattataaaaaatgatatattgcttatcatttttgcataggcctacaaaggtgttatttggtcaatggtgacaggtttgaaagatgttttctgatgctgtaaaaactgcattcatgctaacattaaggagattgtatcatggcgttttcattacatgctgttggtcccttccaattgggtcttttcctcacctccaaatcattaacatggcagacgtgccctatgtggcagtggtagcttcattcaacaaacatttactgagcacttactctatgctaagcacttggctggggtctgggaacataaaaataaaatcattgtgatctgtgtttgaaggaattttacattgtaatgttcaagatacaatacgtcactacctgtgctaactgcgctaattggatgaagcacacagttgtgtataggggtaacacctaaagcagaggtaagggacagtgacccaggaatgtttcctagagaagccgattactctggctagtcctgaaaagcaaatagatgtaagctcagcaggtggggtgtggtcattgtaggtttgctcacgtaggtatgggctgttttgcgattgtgctccataactatacctgtaaatggttcctctgctttggacagtaacagggaaggggcaactgagatccagggtttctttcaggagatgcagttgtccactccatgctggtactccctagatctcagctgccctgactgaaggttctagtctcccaagctgaagaccgaggattgagtcttggagactatctaatgatgagcaattaataactagtcctcattaattctttttttagacattttagcctgtggtctgagcaagtttaataataagagatagttgaaggtttggactttcttcatgtaattccacatatctcagcacaggtggcaagcagtgtaataatgttggtctctaggtcatgagattatcctcttatagcttggaatgttacaagtccactggactttatcttaaaataatgccatattcaatttcttgtttttgaaatggattccagcaaaatgtatgtgattgtgtctatttcagaaaaatataaatgctaagttcttggaaatttatgtgaaatctaattttatagagtttatatagaatcattgtaagatgcaatagagacatctggtatttaaaatctttttgaatctacattttgtagatgtgtgtgctatagcttatgtgtttgtaaatgtttaacttgtctttgttatctataccaagatataactggctgaaaaatatttattatgcatggaaagcactctgtaaaccttgtgaagtgataaataagtgaaaggtataattgttagttgacattaatataaaaaaggattattcttcaataaaattggttgatttgaagggaaaaaatccttttagttgaactagtagaagttagtaataactattgactcttgttttgtttattaaggaaactagcattgttaatatatactgattaatatttaattattcacagttgtttaattatatatttgtggatttcttttctaaatgttttaggcatatgaaaatattatagtacaacacctgtaatttttaagtagatcaaatattttctgtaagattgctttaaatgctccttataaattcacattgcaaaagtaacttaatatggaattaacacttgtcagataataaaacagccaaacttgt

SEQ ID NO: 2070 - DNA, 2223 bp, Homo sapiens
agcctcggggagcagcccgggctgtttgttccgtcaccggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataa

SEQ ID NO: 2071 - DNA, 1948 bp, Homo sapiens
acagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcatgtaaggaagtctcttattcaaatgctattcaaagcatgtaagtttatgttgttaagaaaatgaagaaaaggtattaattgaagcccaacttttcatctgatatttctggcctttaatcttagtgaatttcacttttactccgcatttacattgatcttcattcatacgtatgtatttgcttgcttatattctcaaacatgtgtaattcacttggacccttttgagtataatattccttgaagaatataaactgcatggagcgggtctcttgtttctcatagccaattgtagcattacatcatattgaaagcagtagctacctatatttaatgaagtatgtaaaagcaaattaaatctcttagaatagaagcaaagaagatttctattcaaaacatttcataaaatttcttaaaaaatatttcatctgggattttcctgaagtcctactcattaatttgtgatggaagtccctatattctcttcactactactgtaatatctttgtttttatgttactacaaaggaatgactgaggttgggtattttataaagaaaaaaggtttatttggcttacggttctgcagactgtacaagaagcatgacactagcatctgcttcttgtgagagccgcaggaagcttccactcatggcagaaggtgaaggggtgcacgcatcatatggcgagaggaaggagaaagagatagcagagggaggtgccaggctctttttaacagtcagatcttgtaagaaccaacagagtgagaagtcactccttaccatgaggacagcaccaagccactcatgagggattgacccccataacccaaataccttccaccaggccccacctccgatattggtgatcaaatttaccatgtgatttggagaggacaaatatccaagctataccacctaagtatcccttctctctcaatggcctactgctttggtagctactgggattctccagtgctctgctatccccacatatgtataaacatgtcaaaaatctcaggagcctctagcaaatcacagctattcttggaagaaaagagaacttgcaagctgttcttcttatacatcaattccttgtgcttgttacagggtgagatgtttgattttagtttcaacagagaaaggagtaggcagaaaatatttatctttgtttgaaaatgtttgaaaaaccactatgtgctaactggaatctgcatctgggtcatttgtgaaagcaactaaatttaactttgtgagcagcttcatttacatagtggtactcataaaaagtattgcattaaccacaccaagttcttgtgagaattatatgaagtgttaacaacttaaaatgttcttcagaaattgtgattgtaaccaaattgtcctgcttcatcagtttggtatatagaattaggtcccaacattttaaaaaatatacaagtttaaaatttgcatgtcttttttacaacagtatagccagtaatatccagcacagtgcctgtttcaattaataaatgctaaatgataaaaatgaataaaggaagaaataaaaaatg

SEQ ID NO: 2072 - DNA, 2217 bp, Homo sapiens
agcctcggggagcagcccgggctgtttgttccgtcaccggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattc

SEQ ID NO: 2073 - DNA, 3334 bp, Homo sapiens
aggcgattcaagatggcggaggacctggacgagctcttggatgaagtcgagtccaagttttgcacacctgaccttctaagacggggtatggtcgagcagcccaaaggctgcggcggcggcacccacagtagcgaccggaaccaagccaaggcgaaagagacgctcagatcaacagaaacatttaaaaaagaagatgatcttgacagtcttattaatgaaatacttgaagagcccaacttggacaaaaaaccctctaaattaaaatctaaatcttcaggtaacacatctgtcagagcttccattgaaggccttggtaaaagttgcagtccggtgtaccttggtggaagctctattccatgtgggattggaacaaatatttcatggagagcatgtgaccatctgcgttgtatagcctgtgatttcttggtagtcagctatgatgactatatgtgggacaaatcgtgtgattatctgtttttcaggaacaacatgccagaatttcacaaattaaaagcaaagttgataaagaagaaaggaacacgggcatatgcctgccagtgtagctggagaactattgaagaagtgactgaccttcagacagatcatcagcttcgctgggtttgtggtaaacattaagaatgcagactgcacattcggacagatgcatccatgagagtggtctccatgaatcatcatcatgtttagacaatagtccctagcaataccattccctgtgggaaaaggcagtgaattttattgatacaactacatacatttttgaagaccaaatggactaaggaagatcatgtattataacactttggaattattcctgatacatggatgtttcacttagtaacaggcatctacattctttactaatctgtcttctgtttaatagaggtttgattatggagttccatacaaatatctagtttttcattagcaactgcaatattgattgctaatacgtttagcaaatcattccccaacttgtagcagttaaagtggataaagccggccagggcaaagagatcatttaggggtgtctacaacacttcttccagtcagatcttttgttgccaaagatcataatttggacatggcagaaaccaggtgatcagtggctgactgaagggtgttcagaagtagttacaggtattttgcaaaaacactgcctcatagctgatcttacctcatcaactcaaagcaatgttatgcacaatattaaatacatgttaccagttttagcttatttttccctcttttgttcatttaactatcaaaagttattttctattttgattacccaataatatataaaaagagtttgatgcacccaaaatcacaaaaatcctaatacatacaggttattgttggattttccaagtactttctatcctttaatgcctaaaactccatcaagggaagtaaacagcaagtaatataatttttcaggcagcctgtggacttctctggtaggatcaggttgacatatcgtttattaggtgagtaagtgaaaagacaagtaaagcataactgaaccaacaggtaacctgttgggctccttcctgacatcactgagatctgaggagccctacaatagcagcacattcaggaaatcaggtccctcaaaatttctagctcccaaccccattgagagattttgggagctttccaatctgccacaaactccctgctacatatgtactatatagttcaaatgtgtgatacagagcaccctgaaagggaataattgaaacaaagttataatcttcttagtcttatgctaaatttattccagccaccctactgaagggaggaagatctgatcattagaatccttttcctagccatgacacatttacatacttgtaaaatttattgtagtaagtctagcattgcaacagaatagatcttataatggccaatcctcacacttttgtattaaggatattatgacagactaagcatggtagctcacgcctgtaatcccagcactttgggaggctgaggcaggcagatcagctgaggtcaggagttcaagaccagcctggccaacatgataaaacaccatctctactaaaaatacaaaaattagctgggcgcggtggtgcatgcctgtaatcccaactactcgggaggccgaggcaggaaaatttattgaacctgggaggcagaggttgtagtgagccaaggtcgcgccactgcgctccagcctggacaacacagtgagactctgtctcaaaaaaaaaaaaaagacattatgacagattttatcttttaataaaaatgtattatatccctaaagttatatctatatgtaattgagtcagaaacctagggggatgtcgattgaagtcgactgctggaaaaaaatagcagagcaacaagatccacacatttagaacctcatagaatttgacacattattcataatggtgcaattctttcttttttattccagtaagcaaatttactaaatcactaatttgaaaaaaaaaattttttttttgagatggagtgtcactctgttgccgggctggagtgcagtggcacgatctctgctcactgcaacctccgcctcgcagcttcaagtgattgtcctgcctcagcctccccagtagctgggattacaggcacacaccaccacgcccagctaatttttgtatttttaatagagacagggtttcaccatgttggccagaatgatgtcgatctcctgaactcgtgatccgcccgcctcagcctcccaaagtagcctacattgcctctactttgaagggacaaagttgtcctggtttttttttcccttttattatttcattataactatcctaaaacttacatacattgcctatgtttggcattccataacataataattataataatcccccaatgtcagaaatgtatgtgtgagttcccatgtttattggcaatttataagctttttaatattgtactattttaaactaaaatgtagaaagaatattatgtttatatacagtcagataaattattaactgttgtaatttaagctgaaaatgaaactattttagtatcagtatagaagaaaagtatagtttctaatcatctataattttaaaatgcaaagcctataaaactttcaagatgttttgcctgtttgtttttaagatttataataattttctatctttagcaagtagctatttttaagccaggtaacttctttatttgaactgtattatactctcagaccctcatcctgcctagaaatgaataagtaataaataattactctgtattatttacttcttttattttatagtaaaatattcatttggatgga

SEQ ID NO: 2074 - DNA, 653 bp, Homo sapiens
atctacaccaacccataattattctttacgatgatccaccttttataatgtagatgtttaaaataaaaaccaaaggaatgaccaatgagagccacagtccctaggaagaactgtaaatgaagacgaatccacatggcacaggatttctcccaacatcctcaaacgggaatcatccgaaggcatcgattctacagcccaaagcctttgtccacaactcccaggggtcagagcttccttctttcgcgccaggccaaagttgctacgtgggatccgatgttgtcgccagactttcagccaaaatcagccttcaaattaacctggaccgcccaacctccgtgcctttccgttacgccgtctcaagggcaaacattccaccctaactcgccagagggtgaactgcccccagatctaactgaaaacacttgcccttctcaagcctaacgagctgggcctgcagcgcttttctgccaccactgactacgatgacatagcaaagaaaaaaatatacctatgaaatccttcgagatcttcactctcaagatccctgggaagcgcacatacaccaccacatggaagctgacgggaaaggaagagtcggtgttttagcaagaaaagagggtgccctaacggcaggagctacgctagatactggc

SEQ ID NO: 2075 - DNA, 3395 bp, Homo sapiens
cttggagcgggcctggttctggggatggtttgggggcgggccgggtcctggggagggtttggggcgggcctggtggggagggggcgggcctagttctgggggtgccccgcccccgcctagccccgcccggcccactgggcccgcgtcccgcaggagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggcgcaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaagcttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaa

SEQ ID NO: 2076 - DNA, 2306 bp, Homo sapiens
ggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggcgcaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctgattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctcttt

SEQ ID NO: 2077 - DNA, 2622 bp, Homo sapiens
agtccgggccgagcccgcggcgccccaggccccagcggccccaccgcccaccagggctgggcgaggcttcctcccggcgcccccactatcccgcgacctcgggcgccggaggggatgagtcccggatgcccggcgcccaggccccgagggatgccctgaagcgctggggagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggcgcaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctgattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaa

SEQ ID NO: 2078 - DNA, 1817 bp, Homo sapiens
aaaaatcagaataagaagtacctgacatactttctacatctgtagttgcggaagacattttaataggtcttctcatagcctttctttgctaaggacattgtgactctccagagagcaacagtgatggctctagaatgtctaggaaaaagaagggcttaatgtcaggagtctgcttggggcacacaacactagaagatgtccttctgcacattgtttcatatcgagtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgagtaagtgaaattttgctgtattcatgtttttgtgacttataaaataggatgataaggagagaacatgaactctggagtcagacctgttacctcggacatgatactcttagctttgtcatttagtatttgagtaattttgggcaagctaacatctctggtcgttctcatctgtaaaatgagaataaatgaaacccactaaccagaattggtatgaaaatgaaatgtggcagaaaaaaaatgaaagtgaatagtatcaccactgacacacaagcactaaaggcccttcctgtctccatcaggtatggatttggggcaacatttggccaggtcttgtttatctttctgttcatctattctgtctaattcagtgctttgtttacaacgaatgtcttacaaatgctgactgaacactagcatacctgcatgaacaacaggtaaataaattttagatgtgttttaatgtttattaatctatcctgtcagagaagaactgccagttatagataaatatgatgccaggtcagggctgaagagttgggcaggttgttatctgcatggggtcactaggttccagtggagaggtgggggctaagctctcacccgctctgcagccacctggcacccggtttcagtttcctgaaagggagccttctacttgctgacgactgcctcatctcttctgaggtttcctctgataaacaattttctctgctttttttttttaattatgaaatacttaaaatgtaaaggagataatgtgacacacatttacccataattgagattgccataattgctataactttttcaaaattttgacttaatttcagacttttagaaaaattggccaggtgtgatggctcatgcctgtaatcccagcactttgggaggccaaggtgggtaaattacttgaacccagcagttcgagacttgcctgggcaacatagtgagaccttgtctctactgaaaacaaact

SEQ ID NO: 2079 - DNA, 1835 bp, Homo sapiens
ttatggcagtgggagtcgaagcgagggtctgaagttcacgactactagaaggggaggggagtggaaaggctctcagtgaaaaaggtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgagtaagtgaaattttgctgtattcatgtttttgtgacttataaaataggatgataaggagagaacatgaactctggagtcagacctgttacctcggacatgatactcttagctttgtcatttagtatttgagtaattttgggcaagctaacatctctggtcgttctcatctgtaaaatgagaataaatgaaacccactaaccagaattggtatgaaaatgaaatgtggcagaaaaaaaatgaaagtgaatagtatcaccactgacacacaagcactaaaggcccttcctgtctccatcaggtatggatttggggcaacatttggccaggtcttgtttatctttctgttcatctattctgtctaattcagtgctttgtttacaacgaatgtcttacaaatgctgactgaacactagcatacctgcatgaacaacaggtaaataaattttagatgtgttttaatgtttattaatctatcctgtcagagaagaactgccagttatagataaatatgatgccaggtcagggctgaagagttgggcaggttgttatctgcatggggtcactaggttccagtggagaggtgggggctaagctctcacccgctctgcagccacctggcacccggtttcagtttcctgaaagggagccttctacttgctgacgactgcctcatctcttctgaggtttcctctgataaacaattttctctgctttttttttttaattatgaaatacttaaaatgtaaaggagataatgtgacacacatttacccataattgagattgccataattgctataactttttcaaaattttgacttaatttcagacttttagaaaaattggccaggtgtgatggctcatgcctgtaatcccagcactttgggaggccaaggtgggtaaattacttgaacccagcagttcgagacttgcctgggcaacatagtgagaccttgtctctactgaaaacaaactaaaaaaaaaattagccaaccatggtggtgcatgcctgtagtcctagctactcgggaagctgaggcaagaggatagcctgagcccaggggagttggggctgaagcctgggtgacagaggaagaccttgccttcaaaaaaacaaaaaaaaagaaaagaaa

SEQ ID NO: 2080 - DNA, 2043 bp, Homo sapiens
cctaatgccctggatcaggccatccaacttgtaggaatatcccaataggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggtaatgaattaaattattaatgatcact

SEQ ID NO: 2081 - DNA, 5093 bp, Homo sapiens
gggacgtgcgcgcatgcgcgctaggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccatcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggggccactgtattttgtgttgctccgaatgcagtatttccatttgaactgtataatgaagaatacttagagcaaagggatctctatctgactcagtgccaacaacagctggaacaatttattgccacatatggacctgggacaactattttctctagtgatgaataagcaatttgaggaatttttgttcattcctacttaagcagtggagaaaaagtgtgactattttgagagtgactttgaagtaatgctttgataatactctgtacaggaatatattacaatactgtttttaaaaatataaaatatagtcccctcaaaactaattgctaatgggataaatactaatccaaacctctaaaaccaacagaattttaaaacttagaacaatgtggacaatttaaagtgataaagttgtcaaggagaatactataaagaaaaacctggttagcccagaataccagtggtgaacagataaaaatgtaaatgttgcaatttgagcagtgtgtaaaatggcaacctttatgtagttcactctactgtcacaagatggcaataactctttacctacaaattactctaaaacatttttcttccacttgtgaacttgctaaactgatgagtaaatactttatataacccgaagcttcaaatgtaaggccttttcatactttattactggcctgtccattacatactactgttttagaagccctaaatatggaatcgggaaaagccttggaagttttccatacgtatacgctaggttaaatgaaaaaaatactttacacggaaacaaggagccaataacttataaattggctctctaaccctaactggttacaagaaaggctccaaaaggcaaagaaaccaacttgcaaatctagtcctcatttttggagggaagatatctgctctgaaaagataggggcaccatgagaaaacaaatccatcttgtaaaatttataaatcctttttagttcagtttccataactttaataaaagatcagttctattcacagaaaagcaaaatgtcattaccaaattgccactttattaaccaagatgttaccatgcatcaattctttcaaaactggtcccttaacagagatgcttaactgtacagctggacctctcccactctccacaggacccggaggaagttgttcactattactgaatacctactagtagcagggagtaaacagtattagttttcagaagccaaaggtagtgtttttgttttttgtttttttgagatggggtctcgctctgtcatgcaggctggagtgcagtggtgttatcttggcactgcaacctccacctcccgggttcaagtgattctcctgctgggattacaggtgcactccaccatgactggctaatttttgtatttttagtagagacagggtttcaccatgttggccaggctggtcttgaactcccgacctcaggtgatctgcctgcctcagtctcccaaagtgctaagacaacaggtatgagccaacacgactggcgactgtagttttcaacaaaatacttacatattacagttctataatgttaagacgtttattttgtgcttctcaaatactacatttcaaacatgtctggctctctatggggggaaggcaaaacacattcctattttataaaactaggatccttttacaattggaaagtttaaaaacttttttttttggagacaggggctgtcaccgtttggagggttgtggcgccacctcagctccctgcagccttgaccttgcaagtaattctcccaccttaggcctccgagtagctgggactacagggacatgctaccaccctgggataacttctgcattttttgtagagatggaattttgccatgtttcccaggctggtctcaagtcatcctcccatctcagtacctcagcttcccagtgttgggattacaggagtgagccaccatgcatggcacaaagatggcttttatttacttatctatatttatatatacatatttatatgtagctgtcacccaagctgtagtgtactgatgcaatcatagctcactgccaccttaatctccccagctcaaaaaacccaacctcagtctcaaagatggttacttcaccacaaaaaaattaaaatgtttaagtttctcattaaagagtagaagtgtacattcagaaacaattatgggaggtaattcattaatattaaatatgccaacggtattttaaaggttattggagaattagaagggggtggggtgcaggacgaaaaattaatgggtgcaatgtacaccattcaggtaatggctgcacaaaaagctcagactccaaactacttcatatacctatgcaacagaactgcacttataccccccaaatctatactgagggaagtgactaagatgttgctatacaggttttataccatttatcatataaaaattataaccttggtaaaaggaatttataagctagtactcaacaggagaaaagatttagctctaaaccttcacccagatataaattcagctttagaattcttgccaatttagtcctagacagactggtctgctcagtcatttctcttaacatagcatattgcttagttattacatgtactagtattaggatgacttttttgttcacaaagatgaaagcaaactgaataaaaaaggtgaaacctttatctgtaagggggaatttgattgctatttggtattaaagagttttaagattcaaccacctggtacaacagcaggctctgaaggggaagccagacagggaacctagaggtacaagcaatgtctccccagctgtcagcctcaatgagaatcaccacccataaataagctaattattgacaagattataatctttcgaatatgttcaaaacaggtctgactagtgactatgagaatggagctatttagagttgatttaaaagaaaacactttattgttcagcaattaaaagttagccaaatatgtatttttctccataatttattgtgatgttatcaacatcaagtaaaatgctcattttcatc

SEQ ID NO: 2082 - DNA, 2373 bp, Homo sapiens
gggacgtgcgcgcatgcgcgctaggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctgtaggtattcaattcaagattttaaaatcagcattgagtttcaaatgatatgtttaattaaattgctaatttacctatttcacttgtttctctgcttgattgctagttggttggtttgtaaatggccttgttccaaaaggactaaaggcttcacaattccttttgttatatcatgttacatcattttaatctctaataatttttttactaaactgatttttattggatgccatatgagatatgtctgggaaaagtgcactgatttcaaatgcaaatccttgtttttaaaaatgtggctgttgggcgggcacggtggctcacacctgtaatcccagcactttgggagtccgagagggcagattgcctgaggtcaggagttcaagaccagcctgggcaacacagtaaaaccctgtctctaataaaatacagaaaa

SEQ ID NO: 2083 - DNA, 5096 bp, Homo sapiens
gggacgtgcgcgcatgcgcgctaggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggggccactgtattttgtgttgctccgaatgcagtatttccatttgaactgtataatgaagaatacttagagcaaagggatctctatctgactcagtgccaacaacagctggaacaatttattgccacatatggacctgggacaactattttctctagtgatgaataagcaatttgaggaatttttgttcattcctacttaagcagtggagaaaaagtgtgactattttgagagtgactttgaagtaatgctttgataatactctgtacaggaatatattacaatactgtttttaaaaatataaaatatagtcccctcaaaactaattgctaatgggataaatactaatccaaacctctaaaaccaacagaattttaaaacttagaacaatgtggacaatttaaagtgataaagttgtcaaggagaatactataaagaaaaacctggttagcccagaataccagtggtgaacagataaaaatgtaaatgttgcaatttgagcagtgtgtaaaatggcaacctttatgtagttcactctactgtcacaagatggcaataactctttacctacaaattactctaaaacatttttcttccacttgtgaacttgctaaactgatgagtaaatactttatataacccgaagcttcaaatgtaaggccttttcatactttattactggcctgtccattacatactactgttttagaagccctaaatatggaatcgggaaaagccttggaagttttccatacgtatacgctaggttaaatgaaaaaaatactttacacggaaacaaggagccaataacttataaattggctctctaaccctaactggttacaagaaaggctccaaaaggcaaagaaaccaacttgcaaatctagtcctcatttttggagggaagatatctgctctgaaaagataggggcaccatgagaaaacaaatccatcttgtaaaatttataaatcctttttagttcagtttccataactttaataaaagatcagttctattcacagaaaagcaaaatgtcattaccaaattgccactttattaaccaagatgttaccatgcatcaattctttcaaaactggtcccttaacagagatgcttaactgtacagctggacctctcccactctccacaggacccggaggaagttgttcactattactgaatacctactagtagcagggagtaaacagtattagttttcagaagccaaaggtagtgtttttgttttttgtttttttgagatggggtctcgctctgtcatgcaggctggagtgcagtggtgttatcttggcactgcaacctccacctcccgggttcaagtgattctcctgctgggattacaggtgcactccaccatgactggctaatttttgtatttttagtagagacagggtttcaccatgttggccaggctggtcttgaactcccgacctcaggtgatctgcctgcctcagtctcccaaagtgctaagacaacaggtatgagccaacacgactggcgactgtagttttcaacaaaatacttacatattacagttctataatgttaagacgtttattttgtgcttctcaaatactacatttcaaacatgtctggctctctatggggggaaggcaaaacacattcctattttataaaactaggatccttttacaattggaaagtttaaaaacttttttttttggagacaggggctgtcaccgtttggagggttgtggcgccacctcagctccctgcagccttgaccttgcaagtaattctcccaccttaggcctccgagtagctgggactacagggacatgctaccaccctgggataacttctgcattttttgtagagatggaattttgccatgtttcccaggctggtctcaagtcatcctcccatctcagtacctcagcttcccagtgttgggattacaggagtgagccaccatgcatggcacaaagatggcttttatttacttatctatatttatatatacatatttatatgtagctgtcacccaagctgtagtgtactgatgcaatcatagctcactgccaccttaatctccccagctcaaaaaacccaacctcagtctcaaagatggttacttcaccacaaaaaaattaaaatgtttaagtttctcattaaagagtagaagtgtacattcagaaacaattatgggaggtaattcattaatattaaatatgccaacggtattttaaaggttattggagaattagaagggggtggggtgcaggacgaaaaattaatgggtgcaatgtacaccattcaggtaatggctgcacaaaaagctcagactccaaactacttcatatacctatgcaacagaactgcacttataccccccaaatctatactgagggaagtgactaagatgttgctatacaggttttataccatttatcatataaaaattataaccttggtaaaaggaatttataagctagtactcaacaggagaaaagatttagctctaaaccttcacccagatataaattcagctttagaattcttgccaatttagtcctagacagactggtctgctcagtcatttctcttaacatagcatattgcttagttattacatgtactagtattaggatgacttttttgttcacaaagatgaaagcaaactgaataaaaaaggtgaaacctttatctgtaagggggaatttgattgctatttggtattaaagagttttaagattcaaccacctggtacaacagcaggctctgaaggggaagccagacagggaacctagaggtacaagcaatgtctccccagctgtcagcctcaatgagaatcaccacccataaataagctaattattgacaagattataatctttcgaatatgttcaaaacaggtctgactagtgactatgagaatggagctatttagagttgatttaaaagaaaacactttattgttcagcaattaaaagttagccaaatatgtatttttctccataatttattgtgatgttatcaacatcaagtaaaatgctcattttcatca

SEQ ID NO: 2084 - DNA, 4735 bp, Homo sapiens
atgattgcaagtactacaatggtacgttcagcaaaggtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtgataaacaaatagttgaaataattgccacaaaggcacttcgtgcttttcaaggatattctaacaaccagccatttaggtttcaatcacttacaattttcctaagagatgaatcagtgaataaaatgaatataggaaatgaatataaaattattggaattccaacctgtgtaaaaacctcacaaactgctgtctgtatagaagcaaatagcataactttttgtaattcaaaagttccttcaggaattagtgacaacttcaggtgtctcctctccttaacttccagctcatgctggaagtttacagcaatacttgccaatatctttgcatcacaaattacccctcctgggacttacaatttgctcaagctctgtttgttgatgagtctagtacagacaactgaccgtaacaaggaactggaagattgcctggatattttaattataacaagtgatactctactcatagacaggcttctgaattttagcataaaccttgtcccccgtggtatacgtcatctagtctctactgaaatttttcccactctatccaggaataagtatggaactggagcagttagcattcaggctggcagtgctttgctagctaaaggtggtatctgctttataggagacttggcttcacacaaaaaagataaacttgaacagcttcaaacagttctggagagcagaagcatcacagtgtacatcccaggaaagaagtttggggaggatattgatcaacagatgacttttccagttcagtgcagtttttggtcttttgttgatgtggattcatcttcaaggagaaatgcacagaaaatcaacactctaattggtcagatggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggggccactgtattttgtgttgctccgaatgcagtatttccatttgaactgtataatgaagaatacttagagcaaagggatctctatctgactcagtgccaacaacagctggaacaatttattgccacatatggacctgggacaactattttctctagtgatgaataagcaatttgaggaatttttgttcattcctacttaagcagtggagaaaaagtgtgactattttgagagtgactttgaagtaatgctttgataatactctgtacaggaatatattacaatactgtttttaaaaatataaaatatagtcccctcaaaactaattgctaatgggataaatactaatccaaacctctaaaaccaacagaattttaaaacttagaacaatgtggacaatttaaagtgataaagttgtcaaggagaatactataaagaaaaacctggttagcccagaataccagtggtgaacagataaaaatgtaaatgttgcaatttgagcagtgtgtaaaatggcaacctttatgtagttcactctactgtcacaagatggcaataactctttacctacaaattactctaaaacatttttcttccacttgtgaacttgctaaactgatgagtaaatactttatataacccgaagcttcaaatgtaaggccttttcatactttattactggcctgtccattacatactactgttttagaagccctaaatatggaatcgggaaaagccttggaagttttccatacgtatacgctaggttaaatgaaaaaaatactttacacggaaacaaggagccaataacttataaattggctctctaaccctaactggttacaagaaaggctccaaaaggcaaagaaaccaacttgcaaatctagtcctcatttttggagggaagatatctgctctgaaaagataggggcaccatgagaaaacaaatccatcttgtaaaatttataaatcctttttagttcagtttccataactttaataaaagatcagttctattcacagaaaagcaaaatgtcattaccaaattgccactttattaaccaagatgttaccatgcatcaattctttcaaaactggtcccttaacagagatgcttaactgtacagctggacctctcccactctccacaggacccggaggaagttgttcactattactgaatacctactagtagcagggagtaaacagtattagttttcagaagccaaaggtagtgtttttgttttttgtttttttgagatggggtctcgctctgtcatgcaggctggagtgcagtggtgttatcttggcactgcaacctccacctcccgggttcaagtgattctcctgctgggattacaggtgcactccaccatgactggctaatttttgtatttttagtagagacagggtttcaccatgttggccaggctggtcttgaactcccgacctcaggtgatctgcctgcctcagtctcccaaagtgctaagacaacaggtatgagccaacacgactggcgactgtagttttcaacaaaatacttacatattacagttctataatgttaagacgtttattttgtgcttctcaaatactacatttcaaacatgtctggctctctatggggggaaggcaaaacacattcctattttataaaactaggatccttttacaattggaaagtttaaaaacttttttttttggagacaggggctgtcaccgtttggagggttgtggcgccacctcagctccctgcagccttgaccttgcaagtaattctcccaccttaggcctccgagtagctgggactacagggacatgctaccaccctgggataacttctgcattttttgtagagatggaattttgccatgtttcccaggctggtctcaagtcatcctcccatctcagtacctcagcttcccagtgttgggattacaggagtgagccaccatgcatggcacaaagatggcttttatttacttatctatatttatatatacatatttatatgtagctgtcacccaagctgtagtgtactgatgcaatcatagctcactgccaccttaatctccccagctcaaaaaacccaacctcagtctcaaagatggttacttcaccacaaaaaaattaaaatgtttaagtttctcattaaagagtagaagtgtacattcagaaacaattatgggaggtaattcattaatattaaatatgccaacggtattttaaaggttattggagaattagaagggggtggggtgcaggacgaaaaattaatgggtgcaatgtacaccattcaggtaatggctgcacaaaaagctcagactccaaactacttcatatacctatgcaacagaactgcacttataccccccaaatctatactgagggaagtgactaagatgttgctatacaggttttataccatttatcatataaaaattataaccttggtaaaaggaatttataagctagtactcaacaggagaaaagatttagctctaaaccttcacccagatataaattcagctttagaattcttgccaatttagtcctagacagactggtctgctcagtcatttctcttaacatagcatattgcttagttattacatgtactagtattaggatgacttttttgttcacaaagatgaaagcaaactgaataaaaaaggtgaaacctttatctgtaagggggaatttgattgctatttggtattaaagagttttaagattcaaccacctggtacaacagcaggctctgaaggggaagccagacagggaacctagaggtacaagcaatgtctccccagctgtcagcctcaatgagaatcaccacccataaataagctaattattgacaagattataatctttcgaatatgttcaaaacaggtctgactagtgactatgagaatggagctatttagagttgatttaaaagaaaacactttattgttcagcaattaaaagttagccaaatatgtatttttctccataatttattgtgatgttatcaacatcaagtaaaatgctcattttcatc

SEQ ID NO: 2085 - DNA, 3513 bp, Homo sapiens
atttctgaaatgagaaagggaattgctggtaccaaaattcacgtttcctttttggtggaaattctccagccaagcttggcgctaacagagtaggcgatttcacttcgtcgtcacctcacaaaaggcttccaaattcactgcggcagacaccgcaaaataaaaatgttaaatacatcctagctgggaggggattgaagcctccaggctcaatcaaaggtttgcaataataggattcatttaaaaaaaaaaaaaaaaaaaaggacagatgggtttagaaaatgttgcagtgaagactggaacgagatgagctcatagcaccagcctgtcttttgtggacccgcacaatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttgtttgtgacattcatgcaccaccataa

SEQ ID NO: 2086 - DNA, 1761 bp, Homo sapiens
ccccctgacatcctccctatccctgctttaggggcttttcctctcttactgtgccataccctccaccgtctcccctcctgtctcctgggctctactcctccctgccctcctctgcgtcctggccctcccgctctcttccgctttgcgctcccaggctccttccacctcctgccagctcccttcctcctccaggtgcgcaccccctaccattagccccgctgcgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcgtaacttcaaatgagcatttttcaactgcagaagaaagtgagtcctgctttgcccaaccaaagccacatgcactgggaagagaatctactgttgatggcaatgtacaaagggaaagccgtcctcccttacaaaagctcaaggtttcagcagagcctacagctaatggtgttaaacccctccaagaacagcccctggccaaggacgtagcccctggaagggatgccacagaccaatcagggtccacagaaaagactcagcctggagagggactggaggaatctgggccgcctcaaccaggtggcaaagaggatgccccagcagcagaaggaaagaagaaagatgcaggagcagggacagaggccgagtctctaaaaggaaatgctgaagctcagcctttaggaccagaagccaagggtcagcctttgcaggcagcagtagagaaggactctctcagagcagtggaggtcactgagaatccacaaactgctgcagagatgaagcctctaggaacaactgagaacgttctgactctgcaaatagctggagagctacaacctcagggcacagtgggaaaggatgagcaggccccgcttctagaaacaatttccaaagagaatgaatctccagaaatattggaaggaagtcagtttgtggaaacagctgaagagcagcaacttcaggcaacattgggaaaagaggagcagccccagcttctagaaagaattcccaaagagaatgtaacaccagaagtattggacagaagtcagcttgtggaaaagcctgttatgaatgatccattccataaaactcctgaaggtccaggaaacatggagcagattcaacctgaaggaatagttggaagcatggagcatccagcacgaaatgtagaggcaggagcatatgtggaaatgatcaggaacatccatactaatgaagaggaccaacgcattgaaggtgagacaggggaaaaggtggaaacagacatggagaatgagaaagtgagtgaaggggctgaaaccaaagaagaagaaacaggagaagtggtggacctttcagcagccacatagatagaagagtgaaccgacacagtgtgttatcatagaggagacaaaaatggtagtgaagcttgtggttatgtatcttatctttctacatttacatgttttctgtaaggagtgtggttatagagagactgttggaaccatgagaaggatgtttctgtgttcttgattatattgttctgcaaaactgctaagccatgaacagttttcttagctacttagaatggttatacatttaaaagtataaaaaccaaagccaataaaaatgatgtgattatttaag

SEQ ID NO: 2087 - DNA, 596 bp, Homo sapiens
agccccgctgcgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagacaggggaaaaggtggaaacagacatggagaatgagaaagtgagtgaaggggctgaaaccaaagaagaagaaacaggagaagtggtggacctttcagcagccacatagatagaagagtgaaccgacacagtgtgttatcatagaggagacaaaaatggtagtgaagcttgtggttatgtatcttatctttctacatttacatgttttctgtaaggagtgtggttatagagagactgttggaaccatgagaaggatgtttctgtgttcttgattatattgttctgcaaaactgctaagccatgaacagttttcttagctacttagaatggttatacatttaaaagtataaaaaccaaagccaataaaaatgatgtgattatttaag

SEQ ID NO: 2088 - DNA, 1445 bp, Homo sapiens
aagacagctgggaaggcgtctcccggaagacgacctccgcagagctgatggcattgagatccattcccggaggggtcagctcctgacgggttcctgagccagtcttaacctgggcaaaggagatgaggagccgagcctgatgcattgtgatggccatctgcccagaattggcccaaacggacaaaagtgctcttgcaaacctttctgatgagactgagactttgaagaactctactgatgaggtacagacttccagctcattcagctcctctggaggacggcagtcctcgcccctgacctctgggagcaaactggagagggaaaagcagactccaagcttggaacaaggagacacacaatctgagcttttggactataaaaattatgaaaagaagttgagtaaaaaatggatcaactacctcaagctcaaagactctaactttgaacggcaccaaccagacaccaaacttccaacagaaatcactcgggtatcagatgaagaattgaatgccctgcagtcttattgcaccatgaagataaatttgattcatcgtagaggggattctaagaagaagacgagcagcagacataaaaagctgcatcttggattggatgtagaggcttcagagagagatgcctttagttgtactgtacccgatgaacttttgaacagaatctactttaaaaacatgaggacaacgccaaaacaggaggcagcagctaagcaacacatatcttatcagtgtccctattgtaacaggaaaagagcggagctggccctgtctgcctttctgaaacaaaagaagactttactggagtcatttctactccaagagagaatagatgaacatcttcataccaaagactttctcacccgtattggagaagcacatcaagactttcccaggctttcagatgaccccagaataatctggaaaagactgactgagaaaagtcatatcagatactctggttttgaaagatcagagacagagcagaagttgcagcgagatggaaatagtgcttgtcatttaccattttctctgccatttctcaagcgacttactctaatcaaaccagagctggtgattgttaatgataatgtgtaatgtggatagatgtctttgttgtgtatttgagtaattaccataatttctacaggcacttgggaaactaacttaagactttactatgcttccttcacagatttgaggactaagaactttcactttttttttcctattatagaaggcactgttgtagttggaatagttataaaaacttttacaaaattccaagagaactatgttggtagtttgggccaggatgttgatggtacagaagcaaagtagtatggggatgtaagagaaacttaaaaagtaataactgtctttggcgatcaaatggctatggggaattaataaatagtagatgtttgaaatgtt

SEQ ID NO: 2089 - DNA, 2698 bp, Homo sapiens
aattttagctgggattatgctgtgattatgtttggcttaacagtaatgaaaataagtttaggctgggtgcggtggctcatgcctgtaatcccagcactttaggaggctgaggcaagcggatcacctgaggtcaggggttcgagacaagcctgaccaagatggagaaaccccgtctctaccaaaaatacaaaattagccgggtgtggtggcgtctgcctgtaatcccagctactggggaagcggaggacaatcgcttgaacccagaaggcagaggttgtggtgagccgagatctcgccattgcactccagcctggacaacaacagcgaaacttcatctcaaaacaataataagtttacaacctctgaatatgtaccaaatggagccaggggtggggagtattaggacaagccccgcactgcagagccccccagctctcactcgtggaccaagtgcatgggacacagccattcggaaagctctttcttttggagtgggtctgggtgttctggttttggtttgcttgttttatcattttgtgacattggcgcctattcttcagtttgcatccctgccttgcttgcttgaagctggagcacaaatgtcccgtcaccctgtaacaacacaagtatgcgtcatgcctgcgaggcttagcttgggaagtggaatctccaggaatctccttcggttgtctgtctgccactttacactgttgctcccatttcggtcactgaggccctgtcccttatcctccagggacatggtgctgtcctatgagctctggctcctttgtgacttttacattgctcctccagatagcagtggcagtggcatttgcaaaaaggctatttgagaacaaataagaaaaaatcttcaaagcgaagatgatagtaaaacagccctcatttttcaaagtccattcttttttctggtccgtgcactgccagctcacttctctggctaaaacccgggggcggcgggggtgtgtgtgggggttagttttgcaaaaagtactgatggcaccgctgtgctccaagttaaccagaacacaagaatcgaaaaagcctgtgagatactggtgctcgtgatcgtaagctccaggtcggggggttttcagatgaacacaaaaagggggctgctcccgtcccaagatgagtgataaatgagtcacttctcatactcgcactcacactcgctccatttcctctgggatgactgtcttccgtcctaccgctgtggctgctgttatttgcctgataaacttctttccctctccctccctctgacacagaaacacacacacacacacacacagacacacacacacacacacagcccgctggatctataagcagtttgtaacaggatgcaccagttctaatcacgtttcaagtcaaatgaaccagtcgcagcttcctaataagtgaatggctgacataaggagttaattcagaagcagctcaatactatggacaatactagtggacaatattagcatactgctcgtacaacaaagataccgtagtctctggtgctgcctcttcaggacgaatttgctgaaagtgagttgtaattagagatgttaaaaaaaacattggctgcgcgcgatggcttactcctgtaatcccagcacttttggaggcgaggcaggtggatgacctgaggttaggagttcgagaccagcctggctaacatggcgaaaccccatctctactaaaaatacaaaaaattagccaggcatcgtggtgggcacctgtaatctcagctacttgggaggctgaggccgaagaatttcttgaacctgggaggtggaggttgcagtgacccgagatcatgccattgcactccagcctgggcaacaagagtgaaattgtgtctcaaataataataataataataataaactgagatttatcattcctcctctctccttttccttgagaacttaataaaaatggaaaatatccattacttcttgggctcttgatgatctcaaactgttaagctggaatggaggatagatgtggtcggtaaacactgaaatcaagaaccttaagtgggccagggccctgctgagcaaagcaatgggtccagattgcccctaacatgcttttccattggaaggagctgctataaactccgaggctcccgggccctgctggagactctgggctggaatcctctgtgatatcctccacagtcgcccattgtatagctttccttggggattcctcagagtggcttccaaccttcccactggcagagtcccctttacccactcccacccctgccatggtccccatttttgtttttgtttttatttttgagacagagtcttgctctgtcctccaggctggagtgcagtggtgcaatcatagctcagtgcagcctccacctcccgggctcaagtgatcctcccacctcagcctcctgagcagctgggcactacagatgtgtgccaccaccacatttggctaatttttttgtatttttagtagagacagggtctcactatgttgcccaggctggcctcaaattcctgggcttaagtgatctgcccacctcggcctcccaaagtgctgggattacgggtgtgagccaccacacccagcacaggtcccatgttttgaagtagttttaactaatcatttggggttttcctcattttttgtagctcaaaaacaaacgcatgaaaattat

SEQ ID NO: 2090 - DNA, 496 bp, Homo sapiens
acccaccggtctcccgaccagcgagcaagctttggacaaggccaaagagcattgggctgctggaagctggggcatcggcgcagccttcggggtgaacttacgtgctcgctgacaatgtccttaaagtcctggcatcctcagagcaagacaaaaagagtgggggcaagcgaaggtaacccccagtggggctctggaagtatggaggcccctctcctttcctccttccttccacctctggccagcgaggcagaactcacaggcaacacctggtttctgcacagatgcagctgcattttgaacctagaggaaagcatggacagcgactggggggcttggtggggggtgtcgctccctagaagggcaccttttctgatatatgggtcagatgggccttggtgcacacaggcaggcttcccaggatggggacattgacaaggaggcaacagtcctctctcctccactccagtgactaataaaagctaacatttatgtagca

SEQ ID NO: 2091 - DNA, 421 bp, Homo sapiens
agaagtcacccggctgggggtgaacttacgtgctcgctgacaatgtccttaaagtcctggcatcctcagagcaagacaaaaagagtgggggcaagcgaaggtaacccccagtggggctctggaagtatggaggcccctctcctttcctccttccttccacctctggccagcgaggcagaactcacaggcaacacctggtttctgcacagatgcagctgcattttgaacctagaggaaagcatggacagcgactggggggcttggtggggggtgtcgctccctagaagggcaccttttctgatatatgggtcagatgggccttggtgcacacaggcaggcttcccaggatggggacattgacaaggaggcaacagtcctctctcctccactccagtgactaataaaagctaacatttatgta

SEQ ID NO: 2092 - DNA, 2016 bp, Homo sapiens
cccgagctccgcggggactcgggccgggatcctcgggcggctgcattggccggggccggggccgggagcgggccatgatgggccggcggcgcgccttcgccgtggacggccgggatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgtaaa

SEQ ID NO: 2093 - DNA, 1977 bp, Homo sapiens
cccgagctccgcggggactcgggccgggatcctcgggcggctgcattggccggggccggggccgggagcgggccatgatgggccggcggcgcgccttcgccgtggacggccgggatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgaaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgagga

SEQ ID NO: 2094 - DNA, 2021 bp, Homo sapiens
gtctgggggccgcgcccagctgggtcgggacgcgctccctgagctgcccgagctccgcggggactcgggccgggatcctcgggcggctgcattggccggggccggggccgggagcgggccatgatgggccggcggcgcgccttcgccgtggacggccgggatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcc

SEQ ID NO: 2095 - DNA, 325 bp, Homo sapiens
gcttaaaaagctgcacgcaagtgttaaacttctgtaggaggaatactgttggcgttcaaaagcattgctgtttcaacaatggccaagaacaaattaagagggccgaagtccaggaatgtatttcacatagccagccaaaaaaactttaaggctaaaaacaaagcaaaaccagttaccactaatcttaagaaggttcttcatttttcctagaaaggtaaggatggtttcaagcatttgtctaaaaaaatataaaaaaaaaggaagaaaaataacctccctttcttgaaaacaaatgttgaaaagaaataaacattttaactacaaa

SEQ ID NO: 2096 - DNA, 853 bp, Homo sapiens
ctagacgccgtacgtgccagatggtgttacctggagcttaaaaagctgcacgcaagtgttaaacttctgacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgttt

SEQ ID NO: 2097 - DNA, 580 bp, Homo sapiens
ccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttgatgaagctacaagattaatggctctgttgtaatatactggtgatgcatctaattctccacaaagaccaataaattgaatgttttatacaattttatttttaaaaa

SEQ ID NO: 2098 - DNA, 477 bp, Homo sapiens
tggtgttacctggagcttaaaaagctgcacgcaagtgttaaacttctggaggaatactgttggcgttcaaaagcattgctgtttcagttaagtagttccttaattacttacaatgtagtaaggctacattgaaggaagatataaatttcagtcaagactacgactgagcaaagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttgatgaagctacaagattaatggctctgttgtaatata

SEQ ID NO: 2099 - DNA, 557 bp, Homo sapiens
agaattagatacatactctgtactcaaagagcagaaaatctactaggagtgaaagacttggaaataatatatgcaccaactttaaaaataatcaagagtaagatagaattttttagatttaattggtacctttaaaaacttaaaattgacttacggttcataaatgtgggcaatttaattgaatttattttcttttctagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttgatgaagctacaagattaatggctctgttgtaatatactggtgatgcatctaattctccacaaagaccaataaattgaatgttttataca

SEQ ID NO: 2100 - DNA, 756 bp, Homo sapiens
gttaagtagttccttaattacttacaatgtagtaaggctacattgaaggaagatataaatttcagtcaagactacgactgagcaaaggtaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaa

SEQ ID NO: 2101 - DNA, 469 bp, Homo sapiens
cctagacgccgtacgtgccagatggtgttacctggagcttaaaaagctgcacgcaagtgttaaacttctgtaggaggaatactgttggcgttcaaaagcattgctgtttcaacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttgatgaagctacaagattaatggctctgttgtaatatactggtgatgcatctaattctccacaaagaccaataaattgaatgttttatacaa

SEQ ID NO: 2102 - DNA, 244 bp, Homo sapiens
gtgagcggaatcctgactggttcatcctccccggaacttcctagacgccgtacgtgccagatggtgttacctggagcttaaaaagctgcacgcaagtgttaaacttctgacaatggccaagaacaaattaagagggccgaagtccaggaatgtatttcacatagccagccaaaaaaactttaaggctaaaaacaaagcaaaaccagttaccactaatcttaagaaggttcttcatttttcctag

SEQ ID NO: 2103 - DNA, 3469 bp, Homo sapiens
gttctcagggccctggtgggtagagccacaccacaggcactcaggctgcaggtggccactcccctccagcagcccaggcaggagggcccctcaaaggcccattgtaggcacgtccgtgtggctccccagcccccgcaagctcacgctagcgcacgccaccacgcccgtccgtggtcccgcccggggcggcttctaggtcagtcctgggcacaacttcgcaggaggagcagcggcaggtgctgcaggcaagggccgccatggctgggggtgtgtggggccggagccgggcccgggaggctcccgtgggggctctaaccctgacagcactgactgaaggaatccgggccaggcaggggcagccccagggacccccttccgcaggccctcagcccaagtcctgggaggtcaaacctgaggctgagccacagacccaggcactcaccgccccctctgaggcagagcctggacgtggggccaccgtccctgaagctggcagcgagccctgctccctcaacagtgccctggaaccagcccctgaggggccccaccaggttccccagagttcctgggaggagggagttcttgccgacctcgcgttgtacacggctgcctgcctggaggaggctggctttgcagggacccaggcgacagtgctcaccctgtcctcagccctggaggcccggggcgagcggttggaggaccaggtgcatgctctggtgcgtgggctgctggcgcaggtgcccagcctagcggaggggaggccctggagggcggccctgcgagtgctgagcgcactggccctggagcatgcgcgggacgtggtgtgtgcgctgctaccccgctctctgcccgccgatcgggtagcagccgagctctggcgcagcctaagccgtaaccagcgtgtaaatgggcaggtgctggtgcaactgctgtgggcgctgaagggtgcttcggggccggagccccaggcactggcggccacacgtgctcttggggagatgctggctgtttcgggctgcgtgggagccacgaggggcttctacccacatctgctgcttgcgctggtcacacagctgcacaagctggcccgcagcccgtgctcccccgacatgcccaagatttgggttctgtcccaccgagggccaccacatagccatgccagctgtgctgtggaggccttgaaggcgctgctcaccggggatggaggccgcatggtggtcacgtgcatggagcaggcaggaggctggaggaggctggtgggagcccacacccacctggagggcgtcctgctgctggccagtgctatggtggcacatgccgaccaccacctgcgaggcctcttcgcagacttgctccctcggcttcgcagcgcggacgacccgcagcgtctcacggctatggccttcttcacagggctgttgcagagccggcccaccgcacggctcctgcgggaggaggtcatcctggagcgactcctcacctggcagggagaccccgaacccactgtgcgctggttgggcctgctgggcctgggccacctcgcgctgaatcgcaggaaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgagagctcagagtggaccctggcccgctgtgaccacgccttttgctggggcctgctggaggagttggtcaccgtggcccactatgacagccccgaggccctgagccacctctgctgccgcctggttcagcgatacccaggccacgtgcccaacttcctgagccagacccagggctacctgcggagtccacaggaccccctgcgccgggcagccgccgtgcttataggcttccttgtccaccacgccagccccggctgtgtcaaccaggacctgctggactccctgttccaggacctagggcgactgcagagcgaccccaagccggctgtggccgcggcagcgcacgtgtccgctcagcaggtggcgatgctggcccgtgcccggggctgcccccgcgggccccgccttctccgcatcgccccgcgccccgcccggcccccaccagtcttcgccgacagccccttccagcgccggagcgtcgcgggccgctggggctgctccggaccccgccgagcctgaggctcggggctggggcccgagggccagggtccgactcgggcaccccacgcgcatagcagcctgtccccgccctgacggaggggctccctgggcctggtgctggacgccaatgccctcccccaccccccacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcctgtgtgcacgcccaatcagaccgagcacttgtgacactaccccaacacctctcccagggctgaatgaggaacgcgccactggacacatgaggaagaggctgctctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaagcgtt

SEQ ID NO: 2104 - DNA, 1036 bp, Homo sapiens
ccgtctcctggcaaccagatgcaggggccatggcactcttaacaccccagggagtgaaagaagtcttccaacttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggctgctccattactgaggctgtgacgatcctggggaacaagcttagagattaccggggccatttcaacaccacccacctgctggccctctgtgactacttccaccacaccttcatccgccactacaaactctaccagtatgtcctgggccaggaccagcaggtcgacctgaccgttgcccacctggaggtgtgcatgccaccccatcccctcccgctggccgagggcatggacagggacttgtggatccacgagcagcaggtggccacactgacggaggccgaggcacagaagcgcgccgacgtgctgctcctgaaagaggcgctgcgcctggagcgggagaactcgctgcagaaggcgttcgctgccgccgcgcctgcgcagcccggccaggtcctggagagacaggagttggagagcctcatctgccaggcagtccacacccagatggagctcctgcaggagctgctgcagcgccagatccagaacacattcgccatcttggacctgaagcttcagaagaagactctgaacctcaacgcccccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgagccttgcggcacggtgagctcagcacccacagagagacttcttgtgattaaaagaaacaaacccatgc

SEQ ID NO: 2105 - DNA, 1342 bp, Homo sapiens
ccgccttttccggcgggccccgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaactggcttctgtctcaaatgatttctactgca

SEQ ID NO: 2106 - DNA, 3236 bp, Homo sapiens
actcactcggctcgaccacgggaagggaaggagcgcgaacgctaaatcccgtgccgcggggagccaagccccctgggccggaaatgcctaatctgaacttccgccctgcccttcagctcaccaaccaattgaattccaggtttcgtgggtccgctctaggcggctgatagtactcaatgctccggcagtcctgctccttcccggttacgtcccttccagcccttggcggagtctgcgggcgagagggcgcaggtgcagaggtgccgccggcggcgtgcggctgcgaaggaagggaccccgacaccgagcgttcctgcggacgctcctcaaccgggggttgttctccgtgctctggacccggcccttcctcacctaggacgtctcgcggtgcactgtccccctctctcgggcgacttttcccccacctccaagtagtgatcaagctcagaatccagctcgcgcccgctgtgcacctagcacttcccacctgtagtcttttgacctcatcgccccctctagaaggctgctgccatcgcttaaatgaggaagccgaggtgcagagaggtttcagacctattgcggtggagctggagttcgagaaccaaccactcggtgctgagacgcgcttgcggaacgggcggcgggcgggggtgaagcggagtgaggggagaggccaggtgcgacccgggcaggtgaggagcacgggcccggagggaggacttacgagaatggaaaggaaagcagcccgtcttcagtgggacagtgggagcattaagatgtcagagaatgagcagttgtgggaagagccatagggtattttattttttagagatggggttttgctctgtcgcccaggctgcaacctcgacctcccgggctcaagcgatcctcctgcctcagcctcccgagtaactgggactacaagcaacgcgccaccacactaaatctttaattttttggggggtggttgaaggtgggggcgggacagggtctctctccgtctcccaggccagagtgcagtggcgcaattacggcccgactcctgggctcaagcgatcctcccacctcagcctccggagtagctgggaccacaggcgcccaccaccacgcccagctagtttttgtatttttttgtagaggtggtgttttgccatgtttcccaggctggtcttgaactcctgagcgcaagtgatccacccgtctcagccttccaaagtgctgggattacaggtgtcagccaccacgcccggccctaaatatttttttaaaagttggatttttcatggtgcccaagggaagagacactcctttccttttactaagaccatttcttttagaaaactttgtaataggaaaatctttctttgccctcttgaaatgtatgtaaattttttaaaaagctgcataagcctcttgccagttttataaaccaggaatttctttcttaaggacctttcttaaggaccttggagtgatttctttgaaataaaaaggccaaggaagatagcttccctccttgtctctgtgggagtttagcagatggctggctccaagttgcaattacctgcttgtcatagagacatgaggtttattttaactttggataaaggcagttagctaacacagatggccgccccaagtaccacgtacctgccttctcgtttagaaacactgtgggcattaggggcaactcatgcagaagacccaggaatcttccaggtatactccatgggatgcctgttccactctggcccattggcacaagctagccttttcttttaaggatagtggggtccgttctgagagcggcctttgcaacatctcacttcccctgttgactgttatttcttttcttcctgctttcctactcccttgatcccaaactcactaggggtatttagtgagcacttactgttgcagtaagactctagccaaggaagacgaagagacagttggagaccaaagagaacttcaattcgggcacccgagcctagagcaggctcatgcccaaaatggctaccgacccagacaaagaaagcaggcttgcttatatgtcgtttcaggcgtgaaaaacaaggcaggatacaagtttcagacaaagacagtaaattattcaacctgtgacaattctgagaaaacttacatttagttatcttgaccagtcaaccttgaagctggacagagctggggtaagggaaaacaggaattacggaagtatgagggagtcgcgaggccggagataagcttggaaggttgagataagctcgcaggtgcaacttcttagcaatgctgagagtggctgcttaaatttcttagcctatgtataacttctaaatagcctacactaaatggtaactattacctatgttgtgtttgttattttaaactttaatgttatttattttatttcattttccttccacattacctctgctgttagcagctttgagaaatgctgctataggatgtgggaagtcattaaaggatttaagcagggagaggcaagatcagattaacatttcagaaaaatatttactgttttccagctgaaactagtagagtacaatttactttctggtcacagcacacagcagtcacatcctggaggaactgtacttctctaagatctagtctgtcctgtggtttaaatgacctttagcaaattgtctttattactttgtacactgctttcaccagtctgctcttccatggctaacggggcagaactgttatttttagggttttccacatccagtatgttcataagatttctaccctgtgtgaacttccagatgtcgaataaaggctggatgctgaccaaagacctttccacattttttacatgtgtgtagggttgctcaccagtagtattcccctgatgcttcataatggttgatcccagagagaatgccctttcacactcattacattcatagggtttctgtccagtgtgagttctgtgatgggaaattaggttagaactttaaacaaaggcctttccacgtttgttacactgataaggcttatttccaatgtggattctttggtgttacacaagattagagctgtagttgaaggttttcccacactctgccttcatagaacttgtctttatagtgaaatctctggtgttttctaaattgtgttagtccttcttaaggcttaccatgttcactacactacacaattcctctccatggtaactatttgggtgctcattaaaggctgtactctga

SEQ ID NO: 2107 - DNA, 2186 bp, Homo sapiens
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaaggtaatgctgtgcctccctctccagccccttctttctcccttccgggcagcccctgatgggctccccgactctgccgacgggcccagcgcaccaaggagtgggcgtcctgcgctcaggagccccgctgagtgaggccaggcgaacctcttaccgtcggcgcctgccctcggtatggtcctgggcccggaggccttgggagcccagcgcgctgagtacacgcacccttcatcccccagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccgctccccacggcgcgcgccccccgcgcacccgactccggcgccctccggattggcctgcgctcgagacgtcaggcactggcggcgggcgcggggctctggtgcgcgtgcgcgagcgtcccccgccccctcccagcccggcgactgctcgggcccggccgccacctgcacggcgggggagccgctcgccgcgggagcgtcaggtgaggggacgcccgacccaaggtcaccaggcgtgggggcgctgggggatcggggaccatcccggctctgaccctggtgcgctccgagaagggcgtgggtcctggagggggatggggaacgcggaggccacgccctccctgagcccggccgaaaatcaaccggctctcgtgggtagcagaggaggccgtgggggatacaggcaccaggtcgcagcgctgcagaggtgcgcaagggccgcccaaagaccagcttgggcctcgcactgcgcccgaggcagacacagggcgttccatcctcttccctccccgctcccgcacagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgctta

SEQ ID NO: 2108 - DNA, 2299 bp, Homo sapiens
catctttcagcagcagcggtagagcagtgaccaggcgtctccgcgatgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccctggccaggctgcgggcggagctggtggaaatgcatttccaaaaccaccagctggctagaactttactggacctaaacatgaaagtgcagcaattgaaaaaggagtatgaactggaaattacatcagactcccaaagcccaaaagatgatgctgcgaatccggaataaagaaatgcacacgcaagggctgggcgcggtggctcacgcctgtaatcccagcactttgggaggccgaggcgggcggatcaagacgtcaggagattgagaccatcctggctaacactgtgaaaccctgcctctactaaaaatacaaaaaattagccagacgtggtggcaggcacctgtagtccctgctactcaggagtctgaggcaggagaatggcgtgaacccaggagacagagcttgcagtgagccgaaatcctgccactgcactccagcctgggtgacagagcaagactccatctcaaaaaaaaaaaaaaaaaaaaaagcacacgcgaagctctggatcctaaaactaacgcatacaaccctgaaacaattctgatgaacacattatgctttgcataagttttgaggggcaatttatagacccaaaacaaatgacaggggaaggtgacagaaaaacatctaagagaggggagagaaaaatgatgtattaccaagttttaaagttatttatttgttatttttactgggacatagaagtaaaatataactatagataaatctctctctgtctctctcactcaaagaatgctttaatgccaactttcggtattcaaccttgtgtcacctgacctttctggcattgcctgagctttcagagtttgtgcttgttttgttttacttgattattctcagtttgtctgtccagcagcctgccctgcttcttgtggagaattgtttctacttggattctaaccatgccctttaggtggtctgtgactaagggtattccatcttcctggatatagtcatgcagctcaaggcaggcagatgggtttgtccttaggatttttgaatgggcactaaaagagtagatgactatttctgccagtagaagctgtggatcaggggcttggaagctgctggtggtcaccatgtgagaaagcccacaccctaatggaggtgactgaaacggaaccactaaaagcacaaaaggggagggagggagggagggtgcttcgcttccttgttcctggggtcaagctgtataagactccaggccttgctcttgtttatgtacatgaaatattctgatatccttctcataaaatctctttttgcctaagtaaattcaagctggagtttcatgacttgtatctagtgttcataactaatacagttgttcagttttaggagttaaaatggttcttactgttgaattggactatctaactgtacccgaaaagtgctgtctttttaatgcaaacagtaaagttaataaaaaatagttgcagatctaagtgatatttataatggttattgtctgcaaaatacaaattaatttataacaagctatgtaattttaatatttaataaactataaaaatcagttcttgaagacaaaggagaacagaagagacacagtctttctcttgttaaaagaaatacaaggacaagcatggtggatcacgcttgtaattccagcactttgggaggctgaggtgggcagattgtttgagctcaggagtttgagaccagcctggtcaacatggcaaaaccccatctctactaaaaatacaaaaattagccaggcgtggtggtgctcgcctatagtaccagctactcaggaggctgaggcataagaatcacttgaacctgggagatggaggttgcagtgagccgagatcatgcccctgcactccagcctgggtgacagagggggacttggcctcgaaaaaataaataaataataaaaataaaataaatgcaagttgttttatgtgtgtg

SEQ ID NO: 2109 - DNA, 2250 bp, Homo sapiens
aagagatgctcaggtcagggagggaatgagacccctggggaagggactcctcccagctgaggagttgattagaagcaatcttggagttggcaggagccttagagactgcctgagccagtccgggaagctggctgaggagcttgggagcaagagactaaaaccagccaagtttgggacagaagggaaggaaagggttgagcagcgaacagagagacaaagaacaggcagttccaaagagccaagaatgcaaatcatttgcagacgccgctggcgagagcctccaccaaggctgctgtgggggtgcctgatgccacgagcacagccacttctacacgtcacggcttatgagaatacaggccactgggagagactcgcatctgtggtttcttcaaaaacacagcagcccacagtgatctctcattcttccatttctatcacattcagtcattaccctccagccacactggactcctttcttgtcctggaacctatcaaactctttcctgtctcaagcctccgcagtcctctctgcttgaactgtggctcctgcagagaaagcatcagaatctccggggaactgattggaaatgcacattctccagccccgcccagaactcctgaattagaaaccctggggtgggacaagcaagccgtgctttctggggcacaggtgattctggtgtgtgctgaagtttaagaaccactggccgagaacattcttaggtctgctcttcttttgcccggcccctccctcgcggaggaattccttcttattcctctctgaagagtggctgctgccaaaaaacgtttgtgagatggcctgggttttctttgttgatttatcatttagtttggaagaaatcagaagtctctttaagaagccaatttgaaacattcaccccatgggaacagttctggatgaagtcagaagatctggaggcagcgcagtaacacacgtaggttttctggccatatggacatttcagagaaaacaacgcacagaggcctggagcaggtgaactggcttaagtagagagaaactaagtcatttggggatatttagcacctaatgtcaaggcagaaatgtctaagatgtaattaacagttatattctaatctcaatagtagctaagtacagacttaaacataagcctgtatataacaaaataaccccaggagaaccaaagaaaatctagaagttgctgctaaaaacagttatgttagtgatacctaggaaagttttttttcttttaacatgtcattgtggtttacaaatgaaaattgaggccgggcgtggtggctcacgcctgtaatcccagcacttttggaggccaaggtgggcgaatcacaaggtcaggagttcaagaccagtctggccaacatggtgaaaccccatctttactaaaaatacaaaaaattagctgggcgtggtggtgggcgcctgtaatctcagctactagggaggctgaggaaggagaatcgcttgaacctgggaggcggaggttgcagtgagccaagatcatgccaccgcactccagcctgggcaacagtgtgagactccatctcaaaacaaacaaacaaacaaatgaaacaaatgaaaattgaaacttcacccatttatggctattgcctaaagaatttataaatgcctgggtcattgcaagcatattgctgacatgtctctcggtctgcgttaccctggtggacatcacgacactcacctgacaggcagcagcttccttccagtaaaagcaaagaatctgaaaggaatggaaaaggctccacacagtgccattttatagaaggaaatgcaacaaggtcacagaccagaaggacagcagcccaggccggctgggcatggaggaagtcccaagatgctgctgggcatgaacagacctcctcatacagtgtgcctctgaagaaataatgcaattgtgtggggccagaggagccacaaatagaacaaagggaggaaaggaaaaatcaatatgcagtaaagaggaggaagggagcccggcgcgatgtctgaatctcgctggcaagaaaaggaaacaggtggtctaagcaggcaacccttcaccccacattgtaatgctggggcatggacgtgttccatagatcactcactgagaagtcttcacaagaacactccaaggcagacactactatccatcttccacacactgggggattgagagtcagaaggattatacagcttgttcaaattataaataaaagccctgagatttg

SEQ ID NO: 2110 - DNA, 588 bp, Homo sapiens
atcaaagcaacaagaagctagggcagaggatttagagggcaagcaagcatgggccaggactttgacagcattcatccagcagcatgcgaactccaaagagaacccgatctccaaagacaaaagtgagcctgaggggagaaaccttgactctccagttgaccactgtgtctctcgacacacggcatatggtgaaacggtgtgatgagaggcatggaaggccattacctcattcacaggaatctcagcatggctctgcaacttcaaagaaggcagttcggggaacagcagacacagctcctttggaaagaatatctgccgcccgaggatgggctctgcctatggaggcaacagtgagtgtcttcagagcccatcagtggcagtggaattaatgaagaaagcaatggcaggaaaagttgaataaagcagacccttcatggtaaatctggttggtaaattgcctgtgaccacatgtgggacaatcactggaggaaccccagttacatttggtcagagtgtggcgaggggaaccttctcaggaaagaaaatagaggtcctgttttaggaaaaaaaataaagatcagaaacctg

SEQ ID NO: 2111 - DNA, 3404 bp, Homo sapiens
cttcctgcgcgctgccctccccggccccgcctccgcggctcccgcccgcgagcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaatctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaaggtgggtggatcacctgaggtcaggagtttgagaccagcctggccaacacggtgaaaccctgtctctattaaaaatacaaaaattagccgggcgtggtggcaggtgcctgtaatcccagttacttgagaggctgaggcaggagaatcgcttgaacctgggagccagaggttgcagtgagccgagattgcgccgctgcactccagcctgggtgacagagcgagactccatctcgaaaaaaacaaaaactttggttgttagacagttcatgcacaaagccaaaatttgtcctttatgtatcttctttccatagtgcttactggagccttccaaaataatgtctcctcaaggtgacagcccctcaggaatttgaaggcaatggtcacaccctcacccactttcctgagttttttctggtttattaacgtcagtctttacagtcagtgctcattgacggtggttttctctggttgtttcctgaacacgtagtgctcttaaagcaatgccctgaggagaatacaattctccaggggcattctgattggcaggtgaagcacagtgccatgttcccagcactgatttgggaagtggcttgtcacatcccacagtgaactcagtcaactggaatgcctaactctctttcataagacctcctgctacattatgtttctcccagactgtactcaggtccaagaacagaatttactagtctatccttctcaaagttcatcattaaattcagtcattcatcct

SEQ ID NO: 2112 - DNA, 3769 bp, Homo sapiens
atgctccttcctgcgcgctgccctccccggccccgcctccgcggctcccgcccgcgagcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacgtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgggctgcccgactgataagtgagactgcccagagagtccatactattggtcagaaacagaagaatgaccagcaccttcggcgtgtccaggctctgctcagtggacgccaggcaaaggggctgacctcagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaatctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaaggtgggtggatcacctgaggtcaggagtttgagaccagcctggccaacacggtgaaaccctgtctctattaaaaatacaaaaattagccgggcgtggtggcaggtgcctgtaatcccagttacttgagaggctgaggcaggagaatcgcttgaacctgggagccagaggttgcagtgagccgagattgcgccgctgcactccagcctgggtgacagagcgagactccatctcgaaaaaaacaaaaactttggttgttagacagttcatgcacaaagccaaaatttgtcctttatgtatcttctttccatagtgcttactggagccttccaaaataatgtctcctcaaggtgacagcccctcaggaatttgaaggcaatggtcacaccctcacccactttcctgagttttttctggtttattaacgtcagtctttacagtcagtgctcattgacggtggttttctctggttgtttcctgaacacgtagtgctcttaaagcaatgccctgaggagaatacaattctccaggggcattctgattggcaggtgaagcacagtgccatgttcccagcactgatttgggaagtggcttgtcacatcccacagtgaactcagtcaactggaatgcctaactctctttcataagacctcctgctacattatgtttctcccagactgtactcaggtccaagaacagaatttactagtctatccttctcaaagttcatcattaaattcagtcattcatcct

SEQ ID NO: 2113 - DNA, 3543 bp, Homo sapiens
atgctgggagtctgccaaaccctcaaacagtactttttggggatcctgaaagccaaggggaccctgcgaccacctgagcgccaggccctgtttggctcctgggagctcatctacggcgccagccaggagctgcttccctacctggaaggaggatgctggggccaagggctggagggcttctgccgccacttggagctctataaccaatttgctgccaactcagagaggtcccagaccaccctgcaggagcagctaaagaaaaataaaggtttccggaggtttgtacggcttcaggaaggccgccctgagtttgggggccttcagctccaggacctgctccctctgcctctgcaacggctccagcagtatgagaatctcgtcgtagctttggctgaaaacacaggtcccaacagccctgaccatcaacagctcacacgggctgcccgactgataagtgagactgcccagagagtccatactattggtcagaaacagaagaatgaccagcaccttcggcgtgtccaggctctgctcagtggacgccaggcaaaggggctgacctcagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaatctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaaggtgggtggatcacctgaggtcaggagtttgagaccagcctggccaacacggtgaaaccctgtctctattaaaaatacaaaaattagccgggcgtggtggcaggtgcctgtaatcccagttacttgagaggctgaggcaggagaatcgcttgaacctgggagccagaggttgcagtgagccgagattgcgccgctgcactccagcctgggtgacagagcgagactccatctcgaaaaaaacaaaaactttggttgttagacagttcatgcacaaagccaaaatttgtcctttatgtatcttctttccatagtgcttactggagccttccaaaataatgtctcctcaaggtgacagcccctcaggaatttgaaggcaatggtcacaccctcacccactttcctgagttttttctggtttattaacgtcagtctttacagtcagtgctcattgacggtggttttctctggttgtttcctgaacacgtagtgctcttaaagcaatgccctgaggagaatacaattctccaggggcattctgattggcaggtgaagcacagtgccatgttcccagcactgatttgggaagtggcttgtcacatcccacagtgaactcagtcaactggaatgcctaactctctttcataagacctcctgctacattatgtttctcccagactgtactcaggtccaagaacagaatttactagtctatccttctcaaagttcatcattaaattcagtcattcatcct

SEQ ID NO: 2114 - DNA, 261 bp, Homo sapiens
aagtttgggaactgctggtctacaccatgaggagaaacgctggacccggcctaagaagaggccctccctcctgtctgacaatgagccatgagaagaccatgggaaaaaaaagaggccaccagaaaccctattgccgaggtcctggcaaggaagaaaaggacagaagagctaatttccctacaagaacacgggtctaggaaacagaaaataaaggaagcttccatttcatgggcagagacatctcggcaaataggctgagcc

SEQ ID NO: 2115 - DNA, 590 bp, Homo sapiens
cacataagacatgcctgcttccccttccgccatgattataaattttctgaggcctctccagccatgcagaactactttttcagataaaattatcctgttgtggtagccatggagatgcaacacttggagtgcccttcaagatagaaattcctgattagctgggaagaatgcagtttgctgactggctccatccttccgggtggacaatagaaatcttgaatgcttatggtatgggtgaccgtaaaagaacaaattcaatgtctaaggaggcttttacaccagaacaactccatcttgaaaaggagctgggtgaaatgaggctgagacctactgtgctgcattcccagacggatcaccaaggattcagaccgataccaatgatgcaataaagacatcatttttcctccaggaaaaaaagagaaatatgggtttagtcaccaaggaagaaggcagtaaatagctttgaacactcacatttacactctaatatatctgtgtaaaggatatgaaggatataaataatttagaaattgtgggggaagtaggtatctctaatattgaataaaaagaaaataaatgaccagatcaaa

SEQ ID NO: 2116 - DNA, 4286 bp, Homo sapiens
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcatgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaa

SEQ ID NO: 2117 - DNA, 1230 bp, Homo sapiens
ggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctgacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttggaagaaggggcaggcgtgcgtacagctggcccggatcctgcagtacctgagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtct

SEQ ID NO: 2118 - DNA, 1278 bp, Homo sapiens
agtctcgggcggggagtggagccacggtcctcgccctgcagctcgccccgccctgctaatgggaccggccagcccgggaggcccctgacccttggggaagcccgctgggcgatggggaccctcgcctcccgccaagtgagctgtgaaccacgtcctgcgcaacctctcgctctccaaaactgtttgtaatatttaaacgatatttggcttaggagaatttcataaagttagccagatctcgggtctcaatttagactcggggtgctggggggcatagcatccctggagtacattggacagcaaaagtccaatcgttgcctgccgagtggacctgcagtgcttaaaccccgtcacccggctggcggggtcccaggccctggggtttctttcgcccgggagtccacgccctgatgctggggtggcccggtccccccgcgggtggctgggggcctggggctgcctcacacgacggtcccagcagggaatctctcgccgtcccgaccttcccggcccttggggagtcgcccggcaggttccggacccacccgcagaggaacccggcccacgcgcggcgcctttaaggcccctccgctcgctccccagtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 2119 - DNA, 781 bp, Homo sapiens
gtggggagccgggagcccagcagccccaggaaagacctggaagcacagggaccttttcaggaaacagagggctggagccaggttctgatcccgaccttgctcctggtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 2120 - DNA, 678 bp, Homo sapiens
cccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctaaagtattttatccaaattcgaataaattttcccaacaacttgcagcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 2121 - DNA, 1629 bp, Homo sapiens
tcctgctgagccagttggagcagagatccctgcagctgcaggtggataaccaggcactgaagtgcgtatggcccacggaggggcgggcggcgggtgcaggctggggccaagctctggcccagctctttccgatcccacgacccaggccagtgacttcccctctctagaggagcctgccagacaggctgaggcttggggcgggatgggggcccctgtgggcttggagagaaatggcagggcccctggccccaggtggccccagtcctggggaagggggaaggctgttgactcatcccagttggggtccaggagccagagagaccagctgagcctgcagctggagcagcagcaggtggatttgcagcggctacagcaggaactggctaatgagcagaaggttcgggccagcctggaggcggctctggtccaggccacctccttcctacagaacattctgcaggtgagcagaagggagagagggagggcgcaaggggagggggagtgagcgcaagatggaagctgcttgcagagaaggggctgcctcaggatcagaggcccctcttttccctgagagactcctggaaagtctgtccttcgctgattctggccttcaaagatccctccaaggtcttaaaggagctggattccttctctgaggctctgaaaggtcttgggcctcagtcttcccgactgaagaatgggtatcccaccacagacagggaaaacttcgtggaaatgggcactgaggttggaatttcctggacgagggtgggtactggggccactgtgggcctgctgccaccccaccctcaccaacagatgcaccgcgatgaagaggacagtgacgttgacgtgacgttccagccatggcacaaggagatgctgcagcaactgctggtcatgctcagctccactgtggccacgagacctcagaaggctgcgtgtccccaccaggagtcacagtcccatggcccacccaaggagagcgtcccgtgggccccaacgcagaggagcggaaacgcagagcaacgctgcagtggggaaggggcgcgaagaaggggcccagaaacccgacccctgagaactccagaaggctgggcaggcagggcgccctagtgcaggaacggagcttcaagaagtttggagcccgtcgagcactgaactcaccagttaagaaaacagagcagcaatttgggggcactcggctcccgggacataatggccgaactgaagctagggaccgggagcccctacgtcgccgccccacgccactcaccatccaccgcttccccggggggcgaggctccaaaacacatcggctcatggctctactcagccgctgtccggcgcccaaaaagccgcccggcctcatgctgcccccattcactccgacaccgccccctgacgtcatcaccccgcagcagccaatcgtgttgccaactgtttggcgtccaccgccaacgtccaatccgggccgggctacgtggccgccatgcttctgaggggcggaagcggcgaggcggtggccgagtccgggaacccaggcgccttcagtagcgcggcgtcacagtgtcccttcgggacttgtgtgggacgctcggagctcttgcttgaccttcggttgggagg

SEQ ID NO: 2122 - DNA, 1722 bp, Homo sapiens
ggcctcttcctggggcctggagccctggttgccatcagccatggctcccaaaaagagtgtgagcaaggcaggcaaggagcttgaagtcaagaagaaagggggcaagaaggagccggtggtggccgtggagccgcctctggccaaggagatgaaggagttctaccacatccagatccgagacctggaggaccggctagcccggtaccagcggaagtgggatgagctggctgtgcaggagaagatgttccgccaggagtttgagcagctggccaataacaagaaggagattgtggccttcctcaagcgcacgctcaaccagcaggtggatgagatcacagacctcaacgagcagctccagaacttgcagctagccaaagagatggagaaggatgccttcgaggcgcagctggcccaggtgcgccacgagttccaggagaccaaggaccagctcaccacggagaacatcatccttggggggaagctggcagccctggaggagttccggctgcagaaagaggaggtcacggacaagttcacattgctggaggagcaggtgcggaagcaggagaatgagttcagggactatgcatacaacctggagaagaagtcggtgctggacaaggacagactgaggaaagagatcatccagcgcgtgaacctcgtggccaatgagttccacaaggtgaccacgaaccggatgtgggagacaaccaagcgggccatcaaagagaacaacggcattaccctgcagatggccagggtctcccagcaaggcatgaagctgctgcaggagaatgagcagctcaagggaagacagaacaatctgtgcaaacagctggagctgctggagaacacccagaaggtcatggccaggcacaaaagaggccaccagaagatcatcctcatgctgactaagaagtgccaggagcagcagcaggacaccaaggaggccgaggagctgcgcctcctgctgagccagttggagcagagatccctgcagctgcaggtggataaccaggcactgaagagccagagagaccagctgagcctgcagctggagcagcagcaggtggatttgcagcggctacagcaggaactggctaatgagcagaaggttcgggccagcctggaggcggctctggtccaggccacctccttcctacagaacattctgcagatgcaccgcgatgaagaggacagtgacgttgacgtgacgttccagccatggcacaaggagatgctgcagcaactgctggtcatgctcagctccactgtggccacgagacctcagaaggctgcgtgtccccaccaggagtcacagtcccatggcccacccaaggagagccggcccagcatccagctgcccaggactgggtctctgctgccgcagctctctgacatcaccccctaccagccgggggatctaggcctggtacctcgccaggtccacatcccacccaacccccaggacctcaggctgctgtcatatatcacccgtgtggggaccttccgggcacacagcagccctgagatgcgtgcccctggttctctaaaaaggcttgaaaagtttagtcttcctgaagttcccctacgtcccaagtaggacacagagagaagaacctactccagaaatggactggtccagtcacagtcacccccactttaatccgcaggcagcctggaacagtctagaggagatttgtataaaaagtagataccaag
